United States Patent 7,960,612 (PLANT QUALITY WITH VARIOUS PROMOTERS) - sequence listing, part 4

SEQ ID NO: 9915 - DNA, 598 bp, Malus x domestica
  Predicted polypeptide sequence is orthologous to G1324, G2893
tttgtttaaactcatcaaaagcttgcccttctttttatgattgagagctggtatgtcgactaagactaaaaccctaagtagtagttctggagaagacgatggcgagcttaggagagggccatggactcttgaagaagactctcttcttattcagtacatagctcgtcacggcgaaggccgatggaacttgctagccaaacgttcaggattaaggagaactggcaaaagttgcagattgagatggttgaattatctgaaacccgacgttaagcgaggaaatcttagtccggaagaacagctcttgattcttgacctccactcaaaaatgggaaacaggtggtcgaaaatcgcgcaatatttaccgggaagaacagacaatgaaatcaagaactactggagaacacgggtgcagaaacaagcccggcatctccgaatcgacacgagcagcgtagagtttcaaaacatgataaggtgctattggatgccaaggttgcagcagaagataggaggagaaatatcgacttcttcagctgtgttaaaccaaaaccataccatttcgcagcctctcgaacagaacaccttcccacattttacagcc

SEQ ID NO: 9916 - DNA, 419 bp, Malus x domestica
  Predicted polypeptide sequence is orthologous to G1335
gaatttctagggttagggttttgagatttgcgattgagagagaaagatgagtgagagactgagcggcaccgtcaagtggttcaatgaccagaaggggttcggcttcataacccccaacgacggtggcgaggatctgtttgtacaccagtcctccatccgatccgaaggtttccgcactctcggagacggcgagacggtcgagtacaccatcgaggaggatgccggtggccgaaccaaggctgtcgacgtgactggcccagaggagggtcccgtacagggtacccgtggtggcgggggtggtggtcgaggccgcggaggcggtggcggaggctacggctttaacggtggttctggtggacgtaacggtgggggtagaggtggccgcggaaccggcgggtaccgaggtggaagctacggat

SEQ ID NO: 9917 - DNA, 426 bp, Malus x domestica
  Predicted polypeptide sequence is orthologous to G1335
cttcataacccccaacgacggcggcgaggatctgttcgttcaccagtcctcgatccgatccgaaggtttccgcactttgggagacggcgagacggtcgagtacaccgtcgaggaggatgccggtggccgaaccaaggctgttgacgtgactggcccagaggaggggcccgttcagggcagccgaggcggcgggggtggtggacgaggccgtggaggcggcggcggcggaggctacggttttaacggtggctctggaggacgtagcggtggcggtagaggtggccgaggaggcggtgggtatggcggaggaggctacggctcgggtggtggtggctacagctcaggcggtggatacggaggtggaggcggtggtggtggtgcttgcttcaagtgtggcgagtctggacacatggcgagggactgctc

SEQ ID NO: 9918 - DNA, 473 bp, Malus x domestica
  Predicted polypeptide sequence is orthologous to G1335
ggcggtggaggcggctatggaggaggcggccgtagcggtggtggaggcggaggtgcttctggagggtgctaccagtgcggtgagtcgggccatttcgctcgggagtgcccgaacaggggttaaagcagtcgtttccaattcagcgtctctctgcctgtgggtggtgctggtgtgtttggtttttgcttaattaagtcttggtttctatgaatcaaaaactcgtttcgagtagtcgtggtttgcggttttatggatcatctcttttgatttcaatctatggaaacatgaagtaaacgatgattccttttgatgtagtaatttttctttctttctttttggttaaggtttttttagtgaggatttggtgttaatctggcagaaaatgtggatctgtggttagtggttggatgttgattcatacacattaatatactctgctcctccttaatgaaaaaaaaaaaaaaaaaattggt

SEQ ID NO: 9919 - DNA, 446 bp, Malus x domestica
  Predicted polypeptide sequence is orthologous to G1335
tggccgtggcagtggtggaggcggtggctgctacaagtgtggacagtctggccatttcgcaagggagtgcccgaacagtggttaaaccagcaacttcacccttactgtcctctcctgcttctggtctgttagtttttgcttaatttagtctggtctttctatgaatcaaacagtactcttttaaggaatcttggatgttggttttgtgggtcatctctgttgcttccaatctgtcgaaacatgaatcgatgacgatgtcttttgatgatttaatttcacttttttcttcttcttattttcaagttattggtgaggatttagtattttggcagaaaaatgtgaatctctgctcctcattgaaaagtttctatgtctgtttgacaagtcttgtctcccactcttattcttaacaaatgtgctttcaaaaaaaaaaaaaaaaaatgctg

SEQ ID NO: 9920 - DNA, 644 bp, Malus x domestica
  misc_feature (17)..(17): n is a, c, g, or t
  misc_feature (25)..(25): n is a, c, g, or t
  misc_feature (27)..(27): n is a, c, g, or t
  Predicted polypeptide sequence is orthologous to G1341
ctcctgcaaatcccggnattgcagnanaaaacccagttctccaaaaagccgaaccggaaacgaggaaggaaacgccatgaaagcttatctccaaagctttcagttttttttttctctcacagtaataatcatcacataaatccaaatggtgataagattagattagattcgattacagtgtaacgttctccagaggctatcgtgtcaagaaatcgccataaagctatgcccttttccttcagcaacctccatttcttcctcccttaaaagctctctcactttttggtttttccttcagtctcaatcgacccctttcggtttctgctgattctgtctctttcccgagaaaaacccagaaaggaaaacccgtttcagaatgctgccaaggctgaacggtggtgtttggatggacgacagggaggacagagactctgtttcctggactagaacctccgccaccgccaccgccggcaacaccgagaacaaggacgagatgggttcttctctgtctaccttcaagtcgatgctggaggttgaagacgactggtacatggcggcgaataacagcatccagggccattcagatgtcggagacatcagcttctcgccgagctttgccgacccagaagcttgctgctcaaccc

SEQ ID NO: 9921 - DNA, 452 bp, Malus x domestica
  Predicted polypeptide sequence is orthologous to G1364, G481, G482, G485
ttttttttttgaccgcagaagcatactttgtcattcaactcagattcaaatacatcatactatcagtattaaaacttaacaactttaccaccttcgagttcttaaaaatgatatgtgacaaaattaaaaacttctactcattgcttcgcgtggaatgaacaacgagatgctgtgccgggattgcaaggtatcatggaacccatcatcaagatcaattgcacattgaccacaagccatgttcactcgcaaaagcgtcaatttccatttcccatattattcaagggcacataataatcctcttgagggttgccatagttcaatgctccctgatggacaaactgtgaacttgggccaggcattgctggaacagcattccctttaaaagaaccatctccacccctagctgagccctttgcatcaccctcagtctccctgtacctactcaagtaaat

SEQ ID NO: 9922 - DNA, 660 bp, Malus x domestica
  Predicted polypeptide sequence is orthologous to G1364, G481, G482, G485
gtatacagtgaatcgttgtgagtaatggcggaggcaccgacgagtccggcgggcgggagccatgagagcggcggcgagcagagcccccagggaggaggaggaggaggaggcggtagcggcgtcagggagcaggatagatatttgccaatcgccaacatcagtcgcatcatgaagaaggctctgccgaccaacggcaagatcgccaaggacgccaaggacaccgtccaggaatgcgtctccgaattcattagcttcgtcaccagcgaggccagcgataagtgccagaaggagaagcggaagaccatcaacggcgacgatttgttgtgggcgatggccacgttagggtttgaggactatatcgagcccctcaggatttacttggctaggtacagggagacagagggtgatgcaaaggggtctgctaggggtggagatggttcttcgaaagggaatgctgttccagcaatgcctggcccaagtgcacagtttgttcatcagggagcattgaattatggcaaccctcaagaggattattatgtgccattgaacaatatgggtaatggaagttgatgcttttgcgagtgatatgaggaagaagagaggacatggattgtggtcaatgtgcaattgatcttgatgatgtgttcctcgatatcttgc

SEQ ID NO: 9923 - DNA, 1055 bp, Malus x domestica
  Predicted polypeptide sequence is orthologous to G137, G145
taacttagcataccctagagaacacgaatatcaaaaagggaaaacaaaacctagtaacataatataataatttgatatgtatgcaatcactgaaatatatttttataatataataagttaaaaagaggaatgggaagagggaaggtggagttgaagaggatcgagaataagataaatcgacaggtaacatttgcaaaaagaaggaatgggctgctaaagaaggcgtacgaactctcagttctctgtgatgctgaggttgctctcatcgtcttctccaccagcggaaagctctatgagttctgcagcggccctagcatagcgaagacgcttgagaggcatcaaagatgcacttatggagaactgggagcaagtcaatctgctgaggacgaacagagcagataccaagaatacttgaagctaaaaacgaaagtagaggccctacaacgcacgcagagacatcttcttggggaagatttggttcatttaggcacgaaggagcttcagcagcttgagaatcaactagatgtgtcgatgaagaaaatcaggtcaacgaagacccaatttatgcatgttcagatttctgagcttcaaaggaaagaagaaatgctactggaagcaaacactggactgagaaggaagttggaagaaattactgctggccatcaacgatcatggaatggcaatcaccaggctgctcaattagaaggattccctgagcatttgcaatacaacaatgcattgcagatcggtactccagtagtaacaaatgatgaggcgaatgtagcaacgtcctcagcacaaaatggtacgggattcttccccggttggatgctctgaatttcgaatcatgcatggtaaccaatcaaagagtagtggtgaccacatgtgttgtttcactgtccaaaagaataagaacgttaataatttgctgcctagtatcttttaatgttatagaagggttcattcattcatgagactaatgcccaagaattcatcacgattgttgtgccctaaaatatttcatttggattttaactttaccagtgagtagtata

SEQ ID NO: 9924 - DNA, 964 bp, Malus x domestica
  Predicted polypeptide sequence is orthologous to G137, G145
gaagagtggagctgaagaggatagagaacaagataaacaggcaagtcacatttgcaaagagaagaaatgggcttctgaagaaagcttatgagctctccgttctctgtgatgctgaggttgctctcatcgtcttttccaaccgtggcaagctctatgagttttgtagcagccctagcattctccaaaccgtagacaggtaccaaaagtgcagttatggtgcggtggatcaagtcaacatacctgcaaaggaacttgagagcagctatcgtgagtacatgaaactcaaaggtagatgtgagtccctacaacgaactcagagaaatcttcttggtgaggaattgggtccattaaacacaaaggagcttgagcagcttgagcgccaacttgaggcctccttgaagcaagttaggtccactaagacccagtatatgctggaccaactttctgcccttcagaacaaggaacaactgttaatcgaagccaacagggatttgacaatgaagttggatgaaattggttcaagaaatcaacttagacagtcatgggaaggaggtgaccagggcatggcatatggaacccagcatcaccatgctcaatcccaagggttcttccagcctttagattgcaatcccactttgcaaatagggtaccctgcagaggggtcagagcagatgggtgccacaactcatgcccaacaagtgaactgtttcatccccggatggatgctttgagtttgtgctgctgatgaatctgatcagtgcctctaatcagccataaaaaaacatatacccaagtttatgcttttttttttctttttttctggcaatatataaactgcatgtaaccttaatttcacataaaatcagcagtgactgcatttcaaggggacctttcaaaggcctaaagtccttttaacttttgttagagggcttaagtttacaatattgcgaacttatttcttgct

SEQ ID NO: 9925 - DNA, 1291 bp, Malus x domestica
  Predicted polypeptide sequence is orthologous to G137, G145
ttggaacctgaggttattgacccaaaagaaaaatcaggattggaacctgaggttaagaagataagccatcactcaagagacagaactacaagacaatcagctctaatctttctctctcttccactctctctctctctctctctctctctctctctctctctctctctctctctgtgtagggttttccaactgagtgagtatctaactttctcttgtgtttcacaaatttggttacagtttggtactgacctagaaaaggaggatcagtttgtaccaaagagagagagaagaacaagaaagggaaagaaaatattgtcaagatcaaaacttttggagattagatacacaaaataatatttttagtaactaaggacatggggagaggaagagtggagctgaagaggatagagaacaagataaacaggcaagtcacatttgcaaagagaagaaatgggcttctgaagaaagcttatgagctctccgttctctgtgatgctgaggttgctctcatcatcttctccaaccgtggcaagctctatgagttttgcagcagctctagcattctcaaaacactagacaggtaccaaaaatgcagttatggtgcagtggatcaagttaatagacctgcaaaggaacttgagagcagctatcgtgagtacatgaaactcaaaggtagatatgagtccctacaacgaactcagagaaaccttcttggtgaggacttgggtccattaaacacaaaggaacttgagcagcttgagcgtcaacttgagggctccttgaagcaagttaggtccactaagacccagtatatgctggaccaactttctgaccttcagaacaaggaacaactgttaatagaagccaacagggatttgacaatgaagttggatgaaattagttcaagaaatcaacttagacaatcatgggaaggtggtgaccagggtatggcatatgcaacccagcatcaccatgctcaatcccaaggattcttccagcctttagattgcaatcccactttgcaaatggggtactctgcagtggggtcagagcagatgagtgctacaactaatgcccagcaagtgaactgtttcatccctggatggatgctttgagcatgtgctgatgaatctgatcagtgcctctaatcactcataagaaagcatgcccaattatgctttttttttcctggcaatattatataaaatgcatgtaacttattttcacataaactcagcagtgactgaatttcaaggggacctttcaaaggcctaaagtccttttagaactc

SEQ ID NO: 9926 - DNA, 1177 bp, Malus x domestica
  Predicted polypeptide sequence is orthologous to G137, G145
attttcttcatgttaccctcatctttttatcccttttggtataccctaaacacacagcctcctgaaagaaagtttgtctacctctgatcttaaccaagtagagagagagagagagagagagagatgggcagaggcagagttgagctgaagaggatagagaataaaattaacaggcaagtgacctttgccaaaagaagaaatgggctgctcaagaaagcttatgagctctcagttctctgcgatgctgaggttgccctcattattttctctagccgtggcaagctctatgaattctgtagcagtttcagcatgatgaaaacgcttgaaaagtaccaaagttgcagttatggttccctggaagccaacctaccagccaacgagacccagaacagctatcaggactatttgatgttgaaggcaagagttgaggtcctccaacaatctcaaagaaaccttcttggggaagatttgtcccacctgaacacaaaggagcttgagcatcttgagcatcaattggagacctctttgaagcaaattaggtcaagaaagactcagtttattctcgatcagctttctgatcttcaaaacagggaacagatgctagttgaagctaacaaagccttgaagaggaagctggaagaaacaagtgtgcatgctccagaaggaatggcatgggaagctgctggccatggccccaacaacattcagcaaactcggcttccttcccactcagaagccttcttccatcccttggaaggaaacaactccagttcccaaattggatacacccatatgggttcagataatgaaatgaatgttggaaatccgggccagtatgttaatggatatattcctgggtggatgctttgactttgattatgcatataatatccatcgtgacatataatatacatatacatatatatatgtatatgtatggaataaaattagcaatggatcatgttgatcaagcttttataatattttctgttatgatcttataattctatgcaacttgtaatgattcttgaaacaataagaataatatatatatatatatatatatatatataaatatatatatatgttttgtaagttgaattaatgtcattgaaaaacttctatgaaatgtatgagaccaatttgtatatataaaggtttacaatccttctttctt

SEQ ID NO: 9927 - DNA, 958 bp, Malus x domestica
  Predicted polypeptide sequence is orthologous to G137, G145
aggtaaagttgagctgaagaggatagagaataaaagtaacaggcaagtgactttttccaagagaagaaatgggctgctcaagaaagcttttgaactctcagttctctgcgatgctgaggttgccctcattattttctctggccgtggcaagctctatgaattctctagcagtttaagcatgatgaaaacgcttgaaaggtaccaaagatgcagttatagttccctggacgccaaccgacctgccaacgagactcagaacagctatcaggagtatttgcagctggagacaagagttgaggccctccaacaatctcaaagaaaccttcttggggaagatttggccaccctgaacacaaagaagcttgaggagcttgagcatcaactagagacctccttgaacaaaattaggtcaacaaagactcaatttatgcttgatcagctttctgatcttcaaaacagggaacaaatgctagttgaagctaataaagccttgaggaggaagctggaagaaacaagtgtgcaagctccacaatttatggcatgggaagctgctggcgatggccacaacaatattcagcaaacttggcttccttccaactcagaagctttcttccatccctttggaggaaacaactccacttcccaaattggatacgcccatttgggttcacataatggaatggatgttggaaatccgggccagcatgttaatggatacattcctgggtggatgctttgactttgtttctgcctaataataatatccatcgagatatatatgtggagaatgaaatttgcaagggatcattgatcaagcttctattttattttttgttgtgatctgttatttctctgcaacttgaaacaataagaatatatacatgttttgtaagttgaattgacgtcactgaaaaacttctatgaaatatatgaaacttaaaaaaaaaaaaaaaaaaaa

SEQ ID NO: 9928 - DNA, 993 bp, Malus x domestica
  Predicted polypeptide sequence is orthologous to G137, G145
acaaaataatatttttagtaactaaggacatggggagaggaagagtggagctgaagaggatagagaacaagataaacaggcaagtcacatttgcaaagagaagaaatgggcttctgaagaaagcttatgagctctccgttctctgtgatgctgaggttgctctcatcatcttctccaaccgtggcaagctctatgagttttgcagcagctctagcatgctcaaaacactagacaggtaccaaaaatgcagttatggtgcagtggatcaagttaatagacctgcaaaggaacttgagagcagctatcgtgagtacatgaaactcaaaggtagatatgagtccctacaacgaactcagagaaaccttcttggtgaggacttgggtccattaaacacaaaggaacttgagcagcttgagcgtcaacttgagggctccttgaagcaagttaggtccactaagacccagtatatgctggaccaactttctgaccttcagaacaaggaacaactgttaatagaagccaacagggatttgacaatgaagttggatgaaattagttcaagaaatcaacttagacaatcatgggaaggtggtgaccagggtatggcatatgcaacccagcatcaccatgctcaatcccaaggattcttccagcctttagattgcaatcccactttgcaaatggggtactctgcagtggggtcagagcagatgagtgctacaactaatgcccagcaagtgaactgtttcatccctggatggatgctttgagcatgtgctgatgaatctgatcagtgcctctaatcactcataagaaagcatgcccaattatgctttttttttcctggcaatattatataaaatgcatgtaacttattttcacgtaaactcagcagtgactgaatttcaaggggacctttcaaaggcctaaagtccttttagaactcatttcttgctttgagactacggttataaaatgttttcctctttttca

SEQ ID NO: 9929 - DNA, 633 bp, Malus x domestica
  Predicted polypeptide sequence is orthologous to G137, G145
gagagagagagagagagagagatgggaagagggagggtggaattgaagaggatagagaacaagatcaacagacaggtgacctttgcgaagagaaggaacggactattgaagaaagcctacgagctttccgttctttgcgatgccgaggttgctctcatcatcttctccaatagaggaaagctgtacgagttttgcagtagttcaagcacgctcaaaactcttgagaggtaccagaagtgcaactatggagcaccggagacaaatatatcaacaagggaggccttggagttgagtagccagcaggagtatttgaagctcaaggcacgttttgaagccctacaacgaaaccaaaggaatctccttggagaagatcttggccctctaagcagcaaagatcttgaatcacttgaaaggcagctggatatgtcgctgaagcagatcagatccacacggacccaatgtatgctggatcagctcacagatcttcagcgaaaggagcacatgctaaacgaagcaaataagaccctgaaagaaaggttgttcgagggataccatgcactcccactgaatgcaaatgccgacgagtacagccgcccacaaccccggcggcgcgggggaggtttctcctcccct

SEQ ID NO: 9930 - DNA, 556 bp, Malus x domestica
  Predicted polypeptide sequence is orthologous to G1384
tgaaacgccagatgggtctgaacttctcgcatccggctggcacataagtgtggagaagttaaaatccaagttgctatcttctagttgatgtgtgacacaaaggttttactttctttgtgggtaaatcacgacagattgaagccatcacgacagattgtcattttgttgctctaccaagaagagtacaaactgcggcgggatggatggcttcatgtaatgtggtctctcctctatgatttcctccctttccccgaaattcctttttgttcatgtacatgtttgatagtaaaagatagccggagtcggactggtaaggaagctgctgttagacgaggaaaagctaggaaacccggaaacctggaaacgtgtatttatatagctaggaagaagggctctcataatagagaatgtcgttggttgctgctggatgggtttcctctacttaaatgttgtttcgtatttagtcctgcggtggtttgtggtcgccgacttgaaattccgaacaaatattgttacttggctactgtttgtgcaaaaaaaaaaaaaaaaaatcggt

SEQ ID NO: 9931 - DNA, 616 bp, Malus x domestica
  misc_feature (449)..(449): n is a, c, g, or t
  Predicted polypeptide sequence is orthologous to G140, G146
cgcattttttttttttttttttatttatatatcagacatatataataaatgttcaaaccaacattatgaaagattcgatcacatgtaagttggaggaacttgttagggtaatttctcacagaaatcttagtagtacacattgctgcaggcataaatataaaaatacagatgagaaatccgctttcatatactaaaatacgtacgtatgcctacgtacttggtaccaacggtcttcattcccaaagcaatcttgatcattcatctggtgttattatacacgcccaccacagtaaactaaatcagcagaagcaatacagaccaagcatatatattaaactaattgaagggaaatctgatcgcggcggggattgtagtgatgattgggttgtaacacgttcacttggaaatagtcccgagagtcgtatggctgaaactgcaagatctcatancttcctcctccagccatcacatttatgttctgctggcccctctcattctcaactatctttgctcgtaggagctggtaattgttgtgcaagtccagttcccttttccgcttgtactcaatttcggcaaaaaagaactcaatctttttggatcggattctactaatgga

SEQ ID NO: 9932 - DNA, 876 bp, Malus x domestica
  Predicted polypeptide sequence is orthologous to G140, G146
gcaattcttccttcccgttgccaagtgcaaccccaatagaaaaactcaaagtcaagaactagctaacagagaaaaccacaattcatcaatttggaggggtttttgccatttttcatccttgcaacaatggagttcccaaatcaagcacccgagagctcctcccagaaaaaattgggaaggggcaaaattgagattaagcggatcgaaaacactacaaatcgacaagttaccttctgcaaacgccgcaacggattgcttaagaaagcctatgaattgtctgttctttgtgatgctgaagttgctcttatcgtgttctccaaccgtggccgcctctatgagtatgctaacaacagtgttagagcaacaatcgacaggtacaaaaaagcatacgctgatcctacgaacagtggatctgtttcagaagccaacactcagttttatcagcaggaagcatccaaactgcgaagacagatccgagaaattcagaattcaaacaggcatatactgggtgaagctcttagctccttgaacgccaaggaactgaagaacctagaaggaagattggagaaaggaatcagcagaataagatccaaaaagaatgaaatgctgttttctgaaatcgaattcatgcaaaaaagggagaccgagctgcaacaccacaacaattttctgagagcaaagatagctgaaaacgagagggaagagcagcagcatacacacatgatgccgggaacttcctacgatcagtcaatgccttcgcattcttatgacaggaacttcctcccagcggtgatcttggagtccaacaataaccattaccctcaccaagtccagacagctctccaacttgtttgaaatgctggactgccgtctgat

SEQ ID NO: 9933 - DNA, 1037 bp, Malus x domestica
  Predicted polypeptide sequence is orthologous to G140, G146
ttctttattttctgcatatctccttgtttagatttgtggagctgtgaaaaaatcccaaaagcttccaactatggcctatgaaagcaaatccttgtccttggactctccccagagaaaattgggtaggggaaagatcgagattaagcggatcgaaaacacaacgaatcgtcaagtgaccttctgcaagaggcgcaatgggttgctcaagaaggcctatgaactctctgtgctctgtgatgcagaggttgctctcatagtcttctctaaccgtggccgcctctatgagtatgccaacaatagtgttaaaggaacaattgagaggtacaagaaggcaagtgcagattcttcaaatactggatcagtttctgaagctagtactcagtactaccagcaagaagctgcgaaattgcgtgcgcggatagtgaaattgcagaatgacaaccggaatatgatgggtgatgcattgaatagtatgtctgtcaaggacctgaagagcctggagaataaactggagaaagcaattagcagaatccgatccaaaaagaatgagctcttgtttgccgaaattgagtacatgcagaaaagggaactggacttgcacaacaataaccagctcctacgagcaaagatagctgagaatgagagggccagcagaacattaaatgtgatggccggaggaggaacttcaagctatgacatcctgcagtctcagccatacgactctcggaactatttccaagtgaacgcgttacaacccaatcatcagtacaatccccgccacgatcagatttctcttcaattagtatgaatgatccagattgcttggggaatgaagaccgttaccaagtacgtaggtatacgtacgtatattagttgatggaaggggatttcttgtctgtatttttatatttatgcctcctgcaacgtgtactactaagacttctgtgagacattaccctaacaagttcttccaactttgatgtgattgaatcttcataatgttggtttgaatatctattatatatgtgtctgataaa

SEQ ID NO: 9934 - DNA, 1065 bp, Malus x domestica
  Predicted polypeptide sequence is orthologous to G140, G146
acccacttcccacttctgcaattcttccttccggttgccaagtgcaaccccaaaagaaaaactcaaagtcaagaactaacagaaagagccacaattcatctattttgaggggtttttgccatttttcatccttgtaacaatggagttcgcaaatcaagcacctgagagctctacccaaaaaaaattgggaagaggcaaaattgagattaagcggatcgaaaacactaccaatcgacaagtcaccttctgcaaacgccgcaacggattgcttaagaaagcctatgaattgtctgttctttgtgatgctgaagttgctcttatcgtcttctccacccgtggccgcctctatgagtatgctaacaacagcgttagagcaacaatcgacaggtacaaaaaagcatgcgctgattctacggacggtggatctgtatcagaagctaacactcagttttatcagcaggaagcatcaaaactgcgaagacagatccgagaaattcagaattcaaacaggcatatactgggggaatcccttagcaccttgaaagtcaaggaactgaaaaacctagaaggaagattggagaaaggaatcagcagaataagatccaaaaagaatgaaatcctgttttctgaaatcgaattcatgcaaaagagggagactgagctgcaacaccacaacaattttctgagagcaaagatagctgaaagcgagagggaacagcagcagcagcaaacacatatgattccgggaacttcctacgatccgtcgatgccttcgaattcgtatgacaggaacttcttccctgtgatcttggagtccaataataaccattaccctcgccaaggccagacagctctccaacttgtttgaaatgctggactgccgtctgatgttcttctatccatatcctctgatctgtcttcataaatctatgagataattgacgttgtagtttttatgtatatgggagaaccagtttgctcatgttctccataatatatatatgtgtgatgatggaccccaattctgtgataacatatatagtaaattttattttctcaccccga

SEQ ID NO: 9935 - DNA, 877 bp, Malus x domestica
  Predicted polypeptide sequence is orthologous to G140, G146
cagatattaagatggggaggggaaagattgaaatcaagaggatcgagaacacgacgaatcggcaagtgaccttctgcaaacgaagaaatgggctgctgaagaaagcatatgaactatccattctctgtgatgctgaagttgccctcattgtcttctctactcgtggccgtctctacgagtactctaacaacaacagcataagaaacaccatagagaggtacaagaaggcatgttcagatagcacaggatcatcctctgttactgaaattaacgctcagaactctaacaggcacttaatgggagatgccttgagcactctgactgtgaaagaactaaagcaggtggagaataggcttgaacgaggcattactagaatcaggtccaagaagcatgaactgctgcttgcagagattgagtacttccagaaaaaggagattgagctggaaaacgaaaatgtttattttcgaactaaggtatcagaagtcgagaggcttcaacaagcaaacatggtttctgggtcagagatgaatgcaatccaggcattagcttctcgccatttctttagccagaatatgatcgagggtggagaagctaccttcccacagcaagacaagaagaacctccatcttgggtaactaattagctttttgaaggcagaatcttcaaatgcaggaaatgctacctcaatcatcttaattatatccagataataatgatgatatatcttctcttatgctgaacaacttttctaattactagctttattatgtatttgtaaggattgtaatatgactttggggtttagtacccagtactacccagaataattactactacactatgatctggtattcaataagtttaaattaattagctt

SEQ ID NO: 9936 - DNA, 701 bp, Malus x domestica
  Predicted polypeptide sequence is orthologous to G1419, G43
agctgatgcaaggcactaccggggtgtgaggagaaggccgtggggaaagtacgcagcggagattcgtgacccaaacagaaggggatcccgggtttggctcggaaccttcgacaccgccattgaagccgccaaagcttacgacgttgctgctttcaagctgcgtggaagcaaagcaattctcaactttccacttgaagctggaagatcagcagaactctcagccgatcatcctctgctggtcagcagaaaaaggaggagagaacggatcaccgaaagtcatgagagttccggtgagatgatcagaaacaaagagataaagaaggaggaggatgttcaggatgtaaaaatccccgcccaagagagagtttcgaccgccgtttgcccattaacaccgtcaagttggacggcggtttgggatctgagcaaagaaaacgaactggggattttcagtgtgcctcctctgtctccgttatctcctcaccccaatttcatgggatattctcagctcatggttacttgaacttttaatttatggttatcattccttcattgccagagtttaatttgtatcatccatctgcaaaaaagcagcataaacagagtactgtaaatagtccagagcaatatggattgaagaactcatattgttttttaagtttgatttgtttatatattcctttaatctttgtataatgaaatac

SEQ ID NO: 9937 - DNA, 618 bp, Malus x domestica
  Predicted polypeptide sequence is orthologous to G1419, G43
cacgaggttaataaatttgtacatacaaatttgatacggtagaatattacagaccatgcatatagtaaatcagtaaatccgtcctccaatcatattctaacatatcggcagaggaggatcctgagattaacacagctccttcaagtgccttctccttcccaaagcacccaactttgaagctccagttcttcagtctcagctacctcctcctgctttaccgatctcctcctcttccgcgccgtgttcaccggcggttccgacactccggcctccaacggaaaattcagtattgctttcctacccctcagcttaaatgcagcacaatcataggccttggcagcatcaacatcagtgtcaaatgtccctagccaaacccgagtacctttccgggccggatcacgtatctccgccgcgtattttccccacggcctccgccggactcccctgtaatgccttaacgcatcaccagggcctgaaacctgttgtaattcatcttttggaccgggattttgagaagtactattttttctctttggtgagctcaaattcaggggctctacttccatggatggtaagttaacgaatttttgggtttcgtttcggaatttgagaattggg

SEQ ID NO: 9938 - DNA, 650 bp, Malus x domestica
  Predicted polypeptide sequence is orthologous to G1451
ccgtggagacccactaaacagaaattttgttaaggtttataagtcagggtcctttggaaggtctctggacattaccaagttcagcagctatcaagagctacgtaacgagcttgctcgtttgtttggccttgaaggtgaattggacgaccctgtgagatcaggctggcagcttgtatttgttgaccgggagaacgatgttcttctcctcggggatgacccctgtccggagtttgtaaatagcgtgtggtgtatcaaaatactctcaccacaggaagtgcagcaaatgggaaaacgaggcctagaacttctgaagtcagtcccaaatcagaggcccccaaacaatatttgcgacgactatggaagccggcaggactcaagaaacttgagcagcgggataacgtccgtggggtcactcgagtattgaacaactttaaccggttaagataccattctctcttctgtaatattatttgcaacccctccaactcttttaaagagttggaagggcagcctaatactttagctttaaagcctagtttatatataagccaatactgtaattaaatggtacgtattttttttcagtatttccttctatcgaaatacgttcaacgttgtattaggagattaaaaaaaaaaaaaaaaaatgc

SEQ ID NO: 9939 - DNA, 620 bp, Malus x domestica
  Predicted polypeptide sequence is orthologous to G1451
attcatcatctcttatgctgcataatgggattccaaacctgagaaatattggcaatggaaatgattcagtgtccgtgccctttggtgcttccaattatgccagtggcacaggcaatgattttccactaaattcggacatgactacatcaagttgtgtagatgaatcaggtttcttgcagtcttcagaaaatgtggactaagtaaatccaactggaacctttgtgaaggttcacaagtcagggtcctttgggaggtcactggatatttctaaattcagcagctatgatgatctgcgcagtgagctcgcacgtatgtttggccttgaaggccaactgaaggaccctcagagatcaggctggcagcttgtatttgttgacagggagaatgatgttcttctccttggtgacgacccttggcaggagtttgtgaacaatgtgtattacatcaagatactctcgcctctggaagtgcaacaaatgggaaaggaaggcctcaacagtgtggcttctgtcccaaacaataagctttccaatggtagcaacaccactgttgactacgtgggtcgacaggacttgagaaactcaaggaatgggattgcatctttgggatcactcaactac

SEQ ID NO: 9940 - DNA, 567 bp, Malus x domestica
  Predicted polypeptide sequence is orthologous to G1478
aagaatggacattctgctttcagtgccagtaaagaaattatcatcattgatgatgttccggaaagtgaagctgatttgacctgcagtgttgcaaagtactctgaagggttgagggaaagccaagtagtttgttccggcagtccagttccagcagctcccagttataactcaaagcgtgtgaataatcctttctctcgttatgagtcacaggaaccttctttactttgtggatcaccagttttgtacaacaccaccttgcatgcagttccctccaggctagccaataatattagtcctgttaagtggagttgtactacttcagaaggctcgggtgtgcagcaccgggcttcttttcttgcagcaccatcgccaagacgacatctgagatctacactgtacgattcaccgagcttgtcatagaaaaacatgtcgcgtttgaatgaggagaaatggcgtgcagtccacatgctgttactccaccaaacgttggttcgaaatcatgcaattttttttcaggtttctgcttaggcatgctttaagctatccagagaatagacagtgttttta

SEQ ID NO: 9941 - DNA, 1256 bp, Malus x domestica
  Predicted polypeptide sequence is orthologous to G148
actagttctctccacagacagttcaccaaaccacccatttttgtgtaaccccaaatcctagagaagaggaatatctctctctctctctctctctgtctctatgcatatgggataacaaatacagagacaaaaagcacaatatagatttcatatttaatttgcaaaaggaaggggaaattgaagaggtgagaatatggggagggggagagtggagctgaagagaatagagaacaagattaacaggcaggtgactttctcaaagaggagaaatggtttattgaagaaagcctatgaactctctgtgctttgtgatgctgaggttggccttatcatcttctctagccgtggcaagctctatgagtttgccagcgctggtatgagcaaaacccttgaacgataccaacgttgctccttcactccacctgagaatagcattgaacgtgaaacacagagctggtaccaagaagtcacaaaactgaaagctaaatatgaatcccttcagcgaactcaaaggcatttgcttggtgaagatcttggaccactgagtgtgaaggagttgcaaaatcttgaaaaacaacttgaaggagctcttgcacaaaccagacaaaggaagacacagcttatgattgaacaaatggaggacctgcgcaaaaaggagcgtcaccttggagacctcaacaagcagctgagggtcaagcttgaggcagaagggcagaatctgaatgtcattcaaaacatgtggagctcagatgcagcggctggaagtagcaacttttctttgcattcttcacaaaccaaccccatggactgtacacctgaacctgtcatacaaatgggataccatcagtatcatcctgctgagggatcatctattccaaggagcttgactggtgagaccaacttcatccaaggatgggttctctgaaaaccttcaataccaaaaatgaaggatatatatttcatattttatctattattgcagcatcataaattatattttctaatatctatactttgcaagaatatatgactttaagaattggaatactgccaacatatatttacttcaagtatgactgacaagagatgtttgtaaatttgtaattatacttctagattcctgtgtttccttattcttatttggttttctttttacttttatttattgataattgcttgtatttttgggccctgacggttggattgtcaaggaccattcaattgagccttggtttacattaaaaaaaaaaaaaaaa

SEQ ID NO: 9942 - DNA, 1233 bp, Malus x domestica
  Predicted polypeptide sequence is orthologous to G1480
tgacaagagtgagtgctatttacgaaaactattacattgcagcagatttcggtcatggcatcgaagctctgcgactcttgccaatcggcgacggcgactctgttctgccgcgccgactccgccttcctctgcgtcaactgcgactccaagatccacgcggccaacaagctcgcctcccgccacccccgtgtctggctctgcgaggtctgcgagcaagctccagctcacgtcacctgcaaggccgacgacgccgccctctgcgtcacctgtgaccgcgacatccactccgccaaccctctcagcagtcgccacgatcgagtccctgtcacgccgttttacgattccgtgaactcggctgcaaactcggtccccgtcgtcaaatctgtcgtcaacttcctcgacgaccgttacttgtccgacgtggacggagagaccgaggtgagcagggaggaggccgaggccgcctcgtggctgctcccgaaccccaaggcgatggagaatccagatctgaactcggggcagtacttgtttcaggaaatggatccgtatctggatctggactacgggcatgtggatccgaaacttgaagaagctcaggagcagaacagctgcggcgcggacggcgtcgttccggtgcagagcaagaacatgcagcctctgctggttaacgaccagagcttcgaactcgacttctccgccggctccaagcccttcgtctacggctaccaccacgctcggtgtctgagccagagtgtatcatcgtcgtcgatggacatcagcgtcgtgccggatggcaacgcggtgaccgctgctgtggagacatcgcaaccggcggtccagctctcgtccgtggatcgcgtggcgagggtgctgaggtacagagagaagcggaagaaccgaaagttcgagaagacgatacggtacgcttcgagaaaagcgtacgcggaaactcggccgcgaatcaaaggcaggttcgcgaagcgcacggaggtggagatcgaagccgagaggatgtgccgctacggcgtcgttccgtcgttttaggttaataatgtaattaaccggtaatcaagctttgtaatttcgtttttttccccgggaaatcggctgtgggtgtaaatatcggtcgagatccggtgtactgtacgatccatggaatcttggccgtcgattttgtaccaagtttttcttctgcagtaatgaaattttaatttggtattggggcgtatcaga

SEQ ID NO: 9943 - DNA, 1235 bp, Malus x domestica
  Predicted polypeptide sequence is orthologous to G1480
agagagagagagtactcgtgcgtgagtgagcgagtgagagctttttcaatatttacgaaaattattacactgcagcagatttcggttatggcgttgaagctttgcgactcgtgcaaatcggcgacagggactctgttctgccgcgctgactccgccttcctctgcgtcaattgcgactccaagatccatgcggccaacaaactcgcctcccgccacgcccgcgtctggctctgcgaggtgtgtgagcaagctccagctcacgtcacatgcaaggccgacgacgccgccctctgcgtcacctgcgaccgcgacatccactccgccaaccctcttagccacgccgacgagcgagtcccagtcacgcccttctacgactcggtgaactcggccaccgattccgtccccgctgtcaaatccgctgttaacttcctcaacgaccgttacttctccgacgttgacggagagatcgaggcgaggagggaggaggccgaggccgcctcgtggctgctcccgaaccccaaggcgatggagaatccggatctgaactcggggcagtacttgttcccggaaatggatccgtatatggatctggactacgggcatgtggatccgaagcttgaagatgctcaggagcagaacagctgcatcacggacggcgtcgttccggagcaaagcaagaacatgcagcctcagctcgtcaacgaccacagcttcgaaatcgacttctccgccgcctccaagcccttcgtctacggctaccaccacgctcagtgtctgagacagagtgtttcatcgtcctcgatggacgtcagcatcgtgccagatgacaacgcgatgacagacgattcaaatccttacaacaagtcaatgacctccgccgtcgagtcatcacatccggcggtccagctctcctccgcagatcgcgaggcgagggtgctgaggtacagagagaagcggaagaaccgaaagttcgagaagacgatacggtacgcttcgagaaaagcgtacgcggagacccgcccgcgaatcaaaggcaggttcgcgaagcgcacggaggtggagatcgaagcggagccgatgtgccgctacggcatcgttccgtcgttttaggttaatgatgtaattaaccggtaatcaagctttgtaatttcgctttttgtgtaaatattggccgtcgattttgtacaactttgttcttatgcagtaatgaatttaatttggtatcggccgtatca

SEQ ID NO: 9944 - DNA, 664 bp, Malus x domestica
  Predicted polypeptide sequence is orthologous to G1480
cacgagggatcattttatttttattattattttgttttcttcgggtgaaaacgaaagcagagagtttccaaggcaaggccctatgaaatgttaaaaaaccaaaacgaaccaaataattaaataaagggcttttgggtgctttcaccggccaatcaataaacgacagttgaaaataaaatagattatcctcattgtcaaaacgtcggaacgacgccgaattgtgggtccgagatgaaagtcgccgagccggagccatagatgagatcgaatgtctcagtttcggttttggtgcgtttcgcaaaccggcctttgattctggggcgagtttcagcatacgctttccgggaagcgtatcggatagtcttctggaacttgcggttcttcctcttctctctgtacctcagcaccctcgcctccctgttcagtccgcagagctgagtcgctggttgactcgcaggggttgccgagaccggtgcgccgggttccgaaacgttgttgctggctttccggccgaaagggtacgatatatcgcccggttctgaaacgttgttgctggctttttgcccgaaagagtacgatacatcgcccggttcagaaacgccgttgcaggcggttcggccgatagtatacgatatatcggatagggagttttggtcggggaaca

SEQ ID NO: 9945 - DNA, 547 bp, Malus x domestica
  Predicted polypeptide sequence is orthologous to G15
gttgacacatgtcgcgctatgattgacttgtgatgtcgacacgtgtcgcactgtgattggcttcctggttggagggaaactcttatgggttcttgacggtataacgttgaccggtgctcaatagtttcgggattagtcaagtatggtacaaacaaaactaattagggttcagtttggtgaagcttgaagagggagagagatgattatattctgaagaagatcgaagatgctgaaaagggattggaattagtttgtgcaaacgagattgttgtgctccctaaatacaagtaaattatgtatgtggcctgaatttgagttttacgatttcaattgacttatattatatgatcgaactatttactcagcttctgtattttcaacgtttgtaagtccattatgtttgatgatggtgatatatgcgctatcgtatgtcatttaactgataggccagagatacattgctcaaggtaatatgactacgactttgcaggttgtcattatttgtatgccttcatatgttgtgctgtaggtcatgtataagtttgag

SEQ ID NO: 9946 - DNA, 617 bp, Malus x domestica
  Predicted polypeptide sequence is orthologous to G15
gaaaaagcagtggattctcaagaggggcttcaatgtatagaggagttacaagacatcaccaacatggaagatggcaagctaggattggaagggttgctggaaataaggatctttatcttgggacattcagcactcaagaggaagctgctgaggcttatgacatagctgcaatcaaattccgaggactgaatgctgtgaccaactttgacataacacggtatgatgtggaccgaattatgtcaagcaataccctccttgccggtgaacttgctaagcgaaataaggaggttgtacccattaatgaggctactaatgaaaccaatgtttcgcaaatcggcaatggggaagccgttgtcccactgaagaatattagtgaaggggaagattggaaaatggcactctatcagtcctcccagcaacttgatcagaagcaaccaagcaccgaaactcagaatgtgattcaagcccaggcagaggactctaccaaaatggggaatgctcatttttccaatgcctcttcattggtgacaagcttaggcagctcaagagaagcaagccctgataagtcaagccagcctagtttcttcggaatgcctccatctgcttccaagtttttc

SEQ ID NO: 9947 - DNA, 741 bp, Malus x domestica
  Predicted polypeptide sequence is orthologous to G15
ccctcccaggaccatatcattaaccataattcactccactaagataaaaactacatgagctattgtttgcatgtaatttagtgaaaaaaactttccacggatgagcaaaaaacacatagcctatggctatggctatgcatctgtccaggctgtgaaaatccgcatgtgaggattggtgagtgctggcctggattggactgttgggatccaagaactcactgcatcacttgaacttgtgaaaaacttggaagcagatggaggcattccaaagaaactcggttggcttgacttatcagggctcccttctcttgagctacctaaacttgtcaccaatgaagatgcattggaaaaatgagcagcccccattttgccagagtcctctgcctcggcttgagtcacattgcgagtttcagcactcagttgcttctgatcaagttgctgggaggactggtagagtgccatttcccaatcttcaccttcactaatgttcttcagtgagacaacggcttccccattgccgatttgggcgacattgttttgattagtagcctcattaacgggcacaacctccttgtttcgcttagcaagttcactggcaagaagggtattgctagacataatctgatccacatcataccgtgttatgtcaaagttggtgacagcattcagtcctccaaatttgataccagctatgtcataaccctcaccagcttcctcctggggtgctgaatgtcccaaaaa

SEQ ID NO: 9948 - DNA, 581 bp, Malus x domestica
  Predicted polypeptide sequence is orthologous to G1506
attttgaagagtttacgaggcaattaacaaatgaggaacaacagcaattactgaaacatctacctccagttgatgatgttaaatttccttatagcctcaaaaatatgtttgatagccctcaattcagagagaacttgacttcctttcagcaactgctagcagaaggcgtttttgatatctccttcctggggacaaaaaccgaagactgtaagactttgaaaaggcttgcattgtccaattcttcaaaatctaaatgggttgaacgctatcatcttctcaagaagtataaaactagccatggaaagtctattgtttctgcacctaacatggcatctagtaactttcgacatgtcaagagactgcgggacaacgagactcaaagtttaccagatgtaaagatgatgaaaagccccaaaaggataattatgaagggtagctatgaaaacaaggatcccatggactacgatggaggttcttgctttagtccaaaaagcctgtttgctttgcctcctgatgggagttctttcctaatggattctatgaattttgtcgacgagagttctgaccaggatctcctcctg

SEQ ID NO: 9949 - DNA, 355 bp, Malus x domestica
  Predicted polypeptide sequence is orthologous to G1510
tttgccataaaacgaacatcacaaatcataaaacaacatgcataacccagaaatttgaagaaagaacacaagtctcacctggattcaagttttagagctttgaagctctcagtttcaatggcagaacattccacggtgttctgctgactcatgcaagggtaatgttgagttcgttaagtcttaaagattccaaatatatgaattttttgttcgattttgtgagggagctaaggtgagggctaggtgaagctttcggagctgagagagagagagagagagatagacaacgagatgatgatgatgatatcgatgagttagtgggtccgggagtgtggtgatgggtgtgtgtgtgtgt

SEQ ID NO: 9950 - DNA, 698 bp, Malus x domestica
  misc_feature (617)..(617): n is a, c, g, or t
  Predicted polypeptide sequence is orthologous to G154, G1797
gagagagagacaaagtgtggcctgaggataaagagagtgggcatccacaatcagataaaaatatccttctctgcgtttcccttctctgtgaatactattctagggtttctgatctagtttccatatttggattccttccaatccaataccgctgtgtccttgctgctcatttttaaggcaaagctaggacatggtgagaagtaaggttgagattaaaagaattgagaataacacaagccggcaagtgaccttctcgaaacgtcgaaaggggttgttaaagaaagcttatgagctttcggttctttgcgatgctgaagttgcagtcatcgtcttctcgcaaaaaggcaggatctatgagttctccagttctgacatgcaacggactataaatcgataccataaacatgaaaatggatcagggccaaccaacaaggttgaagtggaacaatatgtgcagcacttgaagcatgaatcagctattatggccaagaagatagagatcctagaagcttcccagcggtttatggcctagtttgatcatcatctcctgtatttttttctcatctgacattttattggattaggttttcctaaactctgaaatttgtatgtcttangaagcttttgggaaatgatctggattcttgccctgttgaagaactccaagagatcagtagccagctggagcgaagcttacg

SEQ ID NO: 9951 - DNA, 598 bp, Malus x domestica
  Predicted polypeptide sequence is orthologous to G1638
tcatgcacaaaaatactttatcaggcaactcacaggagggaaggacaagagaagatctagcatccatgacatcacaaccgtcaatcttcctgatgtgaaacccgcctcaccagacagtacttctaaaagcccaccatcatcggatctctcctcaaccctggtgcagcagccacaccagcaccagaagttggccagcgtgagcattgactggaaatcgcccgatgagggacagcaaatggttttcggttctgcaaatgggaacaacttcttgggaccgttttgtgggatgtcttcacatgtacctaagcttgaggagcaaaattttctgagtggcaatcttcatggatcgcagttgggacattacaacgcctgttttgagatgcaatcaatgcgatatcagtgaacgtgtgcattagttcgatgtttttggagcgagaagagagtgtactatttgacctatggtgaacaaaagtcgatgaggactgagagtagttagtccccaggttcttggactctacaaaaagatcagttagttcatcttgtgatttaatattcgaattctgaaagtattgatccaaaaaagggaacttatttacat

SEQ ID NO: 9952 - DNA, 577 bp, Malus x domestica
  Predicted polypeptide sequence is orthologous to G1638
tcatcaaacagtacaaggaattagaagaagatgtcagtgatatcgaagccgggcttatcccaattcctggttacaccagtaacaatttcacattggagtgggttaacgatcagggatttgacgggttgaagcagttttacagtgttggtggaaagcgaggtgcctcgactaggcccgctgatcaggagagaaagaaaggggtgccatggacagaagaagaacacaggcaatttctgatgggccttaaaaagtatggaaaaggtgactggagaaacatctctcgaaattttgtgaccacaaggacgcccactcaggttgctagtcatgcacaaaagtactttatcaggcaactcacaggagggacggacaagagaagatctagcatccacgatatcacaacagtcaatctcctcgatgtgaaaccgtcctcacctgacagtactaagagcccgccatcatcggctcattcctcaaccgtggtgcagcagccacaccagcatcagaagttgaccggcacgagcattgactggaaatcagccgatgagggacagcatttggttggttctgcaaatgggaa

SEQ ID NO: 9953 - DNA, 631 bp, Malus x domestica
  Predicted polypeptide sequence is orthologous to G1638
tcacgaggcagtgttggtggaaagcgaagctcctcgactaggcccgcaaatcaggagaggaaaaaaggggtgccttggacagaaaaaaagcacaggcaatttctgatgggccttaaaaagtatggaaaaggtgactggagaaacatctctcgaaattttgtgatcacaaggacgcccactcaggttgctagtcatgcacaaaaatactttatcaggcaactcacaggagggaaggacaaaaaaaaatctagcatccatgacatcacaaccgtcaatcttcctgatgtgaaacccgcctcaccaaacagtacttctaaaagcccaccatcatcggatctctcctcaaccctggtgcagcagccacaccagcaccagaagttggccagcgtgagcattgactggaaatcgcccgatgagggacagcaaatggttttcggttctgcaaatgggaacaacttcttgggaccgttttgtgggatgtcttcacatgtacctaagcttgaggagcaaaattttctgagtggcaatcttcatggatcgcagttgggacattacaacgcctgttttgagatgcaatcaatgcgatatcagtgaacgtgtgcattagttcgatgtttttggagcgagaaga

SEQ ID NO: 9954 - DNA, 654 bp, Malus x domestica
  Predicted polypeptide sequence is orthologous to G1640
aagagatcaacaattttagctatggactgccatgttccgtcactcacacaaacgacaggaacagctctcccacaagaactagccaaggcggtgaataaacagaagacactggaaagcatcggcgataaacaaggggaagcagtaagccgtctgggaacaacgttgatatcgctggtcgtcttttatatctccctacaaaccttcatattccattctgttagccaaaatccaaacattccgtgcaagttctggtgggcgccgttcagcctctcgtgtctgaattgtgtcatcttcaccatccccttcaagagtttcgtcacgagatgggagcgtactcaacgttattacgatatcaattttcttgagcaagatttggttcacctcgagattgtgattttctcctcggatcacgatcagcagctggagcagccggcggagatgttgaggagcgatacgacgaaaatatatcagagacgcgccttcatctgtttggtttctttagctcttgtcgcgtacactattgtcgtcttaacggcatgtcgatacattccctgtcacaaagttgctgttctgtaaacataggtggttggattaagacttcaaattactctcggaccgattaattaatttggacagctggcctcttgattattt

SEQ ID NO: 9955 - DNA, 646 bp, Malus x domestica
  Predicted polypeptide sequence is orthologous to G1646, G715
cacgaggaaaatctaagaggtttgattaatatgaaatgacccacaatcattcgagttagcaacaagagataagatagcctaaattatacaagactgcacattcaacattaaacacagcagtgatcagctagtgattctccaactgctctggatcaatagttttaccaggtctatgtcatcctcacaagaaaaaaataataataatattaattcagcagttccaaaatcatctgccaaagctcaatatccttcctccgtgcccgccacgcaccaaatcatcagcaaattagtctcttcaactttgaccatcaaggttgccctgcccactgctccctccactcccgtacgacccatcatccgccgcagtctgccacaccgactgccacgcctgcgacggaggctgcacgccgtaaaccccagtggggtccaccgcaggcctcccaatcatcatccccccggggccaccagccggctgacccatcggcggatagaaatatggcacaccactcgccgtcgccccgaccatacctccgagacccaccgcctcctccttgatctcgtcgcggggcacaatatccaccaagaaatcgaatatgtcggtgcgggtaatggcggcggcaatgtcgtttttctggagagtccggcg

SEQ ID NO: 9956 - DNA, 525 bp, Malus x domestica
  Predicted polypeptide sequence is orthologous to G1660
agcaacaatctgcagaaaccagtgagttttctgcatttcgtctcggaccggctagaatcggtcgaccggctcagatcggctctgtctctgtgctcgatcggacgggccggttagatcgaaggctggatcgggtcggactggctgaaccggttggatcgggggtcgtacagatgaaccgggtcggatcgggtctgaccggatggaccggtcgaagcggctgaaccaggtcggactttcgctcggccggcggagaccagccaaggttgacggaatgggcttcggacccgatggtttgataactcccatgatgtttcggaggcatggttttaggggacttgtgctaaaacttgtgagacgcagcaaactcaactctgaatttaacttttaacttgttaccaatctcgaaatcgatgcgaaagaaaatgatgagacgagattaaaacccttgtttgaaattccttgatttgaaaagaattctggatcagtaaatcaatggttgacaaaatggatctcccgctagaattt

SEQ ID NO: 9957 - DNA, 518 bp, Malus x domestica
  Predicted polypeptide sequence is orthologous to G1660
gtcaacgggcgatcaaacccgtaaggcgcaaggaagctgagaaagccaagtatatggctaggttcaagcgtgaagagatgaaaatacaagcttgggaaaatcatcagaaggcaaaaacagaagctgagatgaggaaaatagaggtagaggtcgaaaggataagaggacgcgctcatggcaagcttatgaataagttggcagctgcaagacataaggctcaagaaaagcgagcagcagcggaggccaggagaaaccggcaagcagcgaaaacagaacatcaagcagagtacattcgcaaaaccggtcgcatcccgtcctcgttttggtgttggggttggtgctcttgatatcggaatcacaatctgcaaatgtatgtccatgttaatgtaaaaacctaaaaactttatctggcttatcctatgaatgccggaaagtaaagtactcaagtgtaattatcgtcaacatggcgaagggtaatgctgtcactttgcttaaaaaaaaaaaaaaaaaaaaaaaaa

SEQ ID NO: 9958 - DNA, 388 bp, Malus x domestica
  Predicted polypeptide sequence is orthologous to G1666
caaggtgaaggataacgtgaatggcaagaaaataagtattacggaagtgaagagggtgataaatcaaattatacctcaatctgactcttaatccgttattagttgtgtttgtgtaaaaatctgcaggacgatttaggataagcagtttgtgtacgtaattaaagagttttgaaggggaaaaaaattggaaaacaaaataattctgattggtgtttatgggtcatcagtgctacttactgtacaatgttaactagaacattttttttttccttctttttactaattggtgtgtattgtttattcccctgtattgtaatctaacaaagtgtattatttccaagacatttagcataatctaaaaatcattatatctttcaaaaaaaaaaaa

SEQ ID NO: 9959 - DNA, 308 bp, Malus x domestica
  Predicted polypeptide sequence is orthologous to G1666
cgacgtatagagaagcttaatgagaggtttattatactaaggtcgcttgtgccttttgtgacaaaaatggacaaggcttccatattaggggacacaatcgagtacgtgaagcaactgcgtaagaaaattcaggatctcgaggcacgtaacgtgccgatggaggatgatcaacagtcgagatcatccggggaaatgcaaaggtcgagtagttgtaaagagttgcgaagtgggctcccggtagtagagcggacacaggccggtcacgggtcggataaaaggaagttgaggattgtggaaggaagcggtgg

SEQ ID NO: 9960 - DNA, 516 bp, Malus x domestica
  Predicted polypeptide sequence is orthologous to G1752
agcctgcagctaatgatcctccgaggaaccctgcaccagcatcaacaggctatgggaaagaagggaattctagcagtgaaatttcatcaagtggctcatcaggagtgacagaatctgaatactccagctcctcaaaacacgactagtttaaacaatctgaacaaagaccgttttttctgtttgaagattctggtgttctgcgtacttttgtaaaggtgttagtcacgtatcatcctcgtatattagttctgtgagcttgtatgttacctttgcaagcgtacagcagtaatagttttgtaggcatcattttttagcgagtgccgcatacaaggggcaatttgctgttttaggaagccccattaagtatttattttgtcagtataggtgtgttcttgtttatttggtgttgttggaggagctactaaacgctcctttcaatgatcgatatggatatcgatcacgttcgttgattgcatcacttttgtattgctaaagtagtaaccttgcttggtgttg

SEQ ID NO: 9961 - DNA, 369 bp, Malus x domestica
  Predicted polypeptide sequence is orthologous to G1777
atttcagaggagaaggattcgaatctcagagattttagttgggtaaacaatggactctccagacttttcagatcaaggagggttctttcatattcgtacccatttgctttttatatgtttggagaagagctgtttaaggatgagatgacaaaggaggaaagggaaataaaacaaaatttgtttgaggaccagcagcagcaacttgaggaaaatgttgagaaattatccaagtgtttggagtcgccttttgatcagtatagtgagaatgaagttatggatataaggatgcaagtgatcaatctctcagcagttacagataccctatgtcagaaaatgtatgactgtattgagactgatttattgggctct

SEQ ID NO: 9962 - DNA, 432 bp, Malus x domestica
  Predicted polypeptide sequence is orthologous to G1777
tgggttccctcaagaggacaaggcacagcattgctccttacaagtcaaatggtgtggagaaagcttcagaacttacggtttctagggacaccacaacctctaactccgaaagtgatttggccgcctccaacgctgactagaagataacccggcgatgagtaacagaaccttgtcaaccttcatctagctttgagagttcgggcgaaagccgatgctgacgatggttcccgtcgtatacatcttaacattagagcgctctgttctcgtttccaactgagttttcccgacataatcacattttactgcataaggttaggcttagaacattactgtttagaaacctagtttttttatcagatttatgaacttttttggtcttcataaaaaatagagagatcctcttttgttcaaaaaaaaaaaaaaaaaatgctg

SEQ ID NO: 9963 - DNA, 373 bp, Malus x domestica
  Predicted polypeptide sequence is orthologous to G1789
tgggaagtctgctgaggaggtgaagcggcactatgagctcctcattgaggatgtcaagcacattgagtctggcagagttccgtttcctgattatagaggggaataatactaaatctttctctctttggactttgaatggcaaaggctcttgaagtttatgatttctagcgtttccattaagttcatcaagaaacaaagttgtgaaaattagcagatgcatgcagacatgtatatgtaattaaagaaaaccagttggttttatgcagctaaattaaccattgtcgtggctttcgatcagtgtacgaagtagcatctatttggtctatgaaattcaatactactacgattagaaaaaaaaaaaaaaaaaatcgtg

SEQ ID NO: 9964 - DNA, 660 bp, Malus x domestica
  Predicted polypeptide sequence is orthologous to G1789
cacgaggtttctcctctctctctctctctccctctctccctccctccccttaattttccttccacgcttttaactgtagtgtttatagaaaaccatctcactctaagaaattattcaatggcatcaagctcaatgtcctcaagaggctccgactcctcctggactgccaagcaaaacaaagcctttgaaaaggctttggctgtctatgacaaggacactgccgaccgctggtacaatgtcgccaaggcggttggtggcaaaacaccggaggaagtcaagaggcactatgagcttcttgtagaagatgtcaagcatattgagtcaggccaagttcccttcccagattacaggactactggatgagaaacctcaagcttcactggagcagtataactcacagtttatccactagttaataaataaagattggtcactcgatcgcttcatcttcatcgttacatcgctagctaggcgccattttaatgttcaatgacgctgtggtcatggtatagttttgtgttcagtcgtttgagaaatcacaatcagtgattcttttatgtatgtactttgtactagtttccgtttctttcatttgtttcttgctactctaagcttaaagtatgtatgtatgtatgtatgtatgtaccaaaggcatgcatg

SEQ ID NO: 9965 - DNA, 496 bp, Malus x domestica
  Predicted polypeptide sequence is orthologous to G1809
caaacttacagattgctaaggaacagggtgtctgctcaacaagcccgggagaggaaaaagatttacgtcaacgatctggaatcaagagccaaagaattggaggatgggaatttaaagttggaagagaagatatctacggttgttaatgaaaacgccatgcttcgaaaggttcttatgaacacaaggccaaaagtagacgaaggtattgaacaaaagcaaggatcagttaagtaagagcagacaagcataaaggagttcttttaggcagttttaggtgaatatatttagaaattttttagagatcaattccgacgaatgtgaatcacagccttcgattctccagctacatatggtatttgtgcatcacttaatttgatatgaacactcaactagctagtatggaagttttaatgaacttctgtcttctcccttttgtaccatgtatttttcatggaaaatattttttttggatgaaaaaaaaaaaaaaaaaatgcgt

SEQ ID NO: 9966 - DNA, 650 bp, Malus x domestica
  Predicted polypeptide sequence is orthologous to G1809
agctcatcagccagccatagtcagtcccaatcagagcaggagatggtgaagccaaaaaccctatgttatccatctcctcctcctcctccagtttggagcaactacagcaagtacagcagccatctggttcttcttcctcgaggcctcctcatccttctcttcttcttcatagtaacaccaagaacagtaacaaactagaagagagcgatgaagatatgttcacggttccggacgtggaggcgttgccccctcctaataatagtattaataatgcggcctctacaatcgccaaagccaccagtaacaacaacaacccagatgcccagtctggctttccggccaagcgccgccgaggccgaaatcccgtcgataaggagtacaggcgactgaagagattgctaaggaacagggtgtctgctcaacaagcccgggagaggaaaaaggtttacgtcaacgatctggaatcaagagccaaagaattggatgataggaattcaaagttggaagaaaagatctctacgcttgtcaatgaaaacgccatgcttcgaaaggttcttatgaacacaaggccaaaagtggacgaaagtattgagcaaaagcaaggatcagttaagtaagagcagataggcagttttaggtgactatattta

SEQ ID NO: 9967 - DNA, 549 bp, Malus x domestica
  misc_feature (541)..(541): n is a, c, g, or t
  Predicted polypeptide sequence is orthologous to G1850
ttttttttttacctcaaaacactcctgttaatttttgtttctcgatcattttcaattcatttcatacaacggtagtaaattggaaaaagagtacaaaaagttaaaaaaataaatatgtacggggcaccacctataaaaacctcagcatttgggaccgtcttctttccgtcctctggcgcgcttcatatggtactatctcattcccgcccatacgacaccgtcccgggtttcggttcttatcttttccatccacgtggcgccatcccagttattatctcgcacgtgcgcacattcctccccgtgcgttgctgtccacgcttccattatcggcttccataaacaacaatcgcctacgtcatctgatcattttcaatcactttccgagctccagccacgtggcgtcacaatcgcgcttcaagctcccatccgacggctcttgcttcgccccctcggagccttcccgatgttgttcctcttcgtcttcgtctctcctcacgcgcttcaccccgatcgaaaccccgaacaacctcggcctcatctnctcctctt

SEQ ID NO: 9968 - DNA, 554 bp, Malus x domestica
  Predicted polypeptide sequence is orthologous to G1850
ttcctctctctcgctctctctctatctctctctcatcgtcttccaaatttccatgtcaattttcctctaacgttagaggtgcggctttcgatatggctccgacgccggtggagccgaccggcgagtccacgtccagcgagtcgtcgcagcgagctcttccgactccgtttttgaccaagacgtatcagctcgtcgacgatccctcaatcgacgacgtcatctcatggagcgacgacggatccagcttcgtcgtctggaaccccaccgtcttcgccagagatttgctccccaagtacttcaagcacaacaacttctccagcttcgtacggcagctcaacacctacggatttcggaaggttgtgccggaccgatgggaattcttgaacgatagctttcggagaggcgagaagcggcttctctgcgaaatacaacgccggaaaatcaaccctccggcgccgccggtggcgtcggtttgggcggttccgactgctaaaccgaatatttccccggcgaactcgggcgacaagacagtgaaatcttcgaattcgtcgcca

SEQ ID NO: 9969 - DNA, 671 bp, Malus x domestica
  Predicted polypeptide sequence is orthologous to G1855
ttgtactgggggaggtcaaaacgggctatatagagagccttgactgagatttttttcacatcaggtaaaaaaagcactttctatttaagaagctttttctttagagaaatacaagttacccaatttgcagctgctggttcccagtacaaatctttgcttgtttccagtggatttgttgggtttgtggtgttttttgccataaaacttggggtgcagaaagaagcaaagaataagaaaaaagggaaagaggaaaggttcagacgtcagtgtagtttctttaagattttgagagaactttagggtactgagtacttgttttgtttctagcttcaaacttctgtcgctggaaatagaaagaacaatatggccagggattatagtggtggatcgccaaagcatcaccacatagaatccaagaagaagaggctcacttggatcttcggtgttagtgcgctctgcatagtatgttacatgttaggagcttggcaaaccacttctgcccctgtcaatcaatctgagctctaccaaagggttggttgtgatgaaacgccatctcaatccgggaacaaaacttcctcatccgtgtcatcatcatcatcatcgcttcacttggacttcgaaagccatcatcaagtggacatcaacaaaactgaggctgtccagaagttccc

SEQ ID NO: 9970 - DNA, 688 bp, Malus x domestica
  Predicted polypeptide sequence is orthologous to G1855
agttcctgctatgattggtgtcatggcttcgaagaggcttccctaccctgcaagggccttcgatatggctcactgttcccgctgcttgatcccttggacgaactatgatggtatgtatctaattgaagtggacagagttctaaggcctggtggttattggattctttccgggccgcctattcactggaaaaaacactggagaggatgggagagaactcaacaggatttgaaacaagagcaagattctattgagtctcttgcaaagcgcctgtgctggaagaaggtgatcgagaagaacgatctagcaatctggcaaaaacctatcaatcacgtcgaatgcattaagagcaggaaggtgtataaaacaccacatatatgcaaatcagacaatccagatatggcttgggaaagagaaatggagagttgcatttctcctctaccggagacgagcaatcccaatgatgttgctggtggggcgttggagaagtggcctcagcgtgcatttgctatcccgcctagaatcagcagtggttcaataccaggaatcactgctgataaactccgtgaggataatcaactgtggaaggaaagggtggaccattacaagcggatcgtaccaatttccaagggaaggtataggaatgtgatggacatgaatgcttacctcggtggatttgctgcagcattg

SEQ ID NO: 9971 - DNA, 774 bp, Malus x domestica
  Predicted polypeptide sequence is orthologous to G1855
cgttgctgtcggtggcatgttttgtgcttaaaagggaaagagacatggagagttgcattactcctctaccggagacaagcgatcctaatgacgttgctggtggggcgttagagaagtggcctgaacgtgcatttgctgtccctccgagaatcagcagtggttcaataccaggaatcacagctgagaaactccgtgaggataatcaactgtggaaggaaagggtggaacattacaagaggattgtaccaatttccaaaggaagatatcggaatgtgatggacatgaatgcttacctcggtggatttgctgcagcattgtcaaaatatccagtgtgggttatgagcaccgtccccgccaactcaaaccaggacacccttggtgtaatttacgaacgtggttttattggaacgtaccaggactggtgtgaggctttctcaacgtaccctagaacatacgatctcatccacgctggtggggtcttcagcatatatcaggacaggtgtgacataacactcattttgctggagatggataggattctgaggccggaaggaacggttgtgtttagggatacagtagagatcctggtgaagataaaggcgattacagacggaatgaggtggaagagccagattatggatcacgagagtggaccttttaacccagagaaaattcttcttgcagtgaaaacttactggactggtgaagaaaaaagggaagctagtagagatgtagcagtgtattcttctttcccttttgcttgcattctacttt

SEQ ID NO: 9972 - DNA, 570 bp, Malus x domestica
  Predicted polypeptide sequence is orthologous to G1863, G2334
caagcttgaaccccaccccatctctctctctctctctctagatggactttcaccttgagcaatggagaacccagcagcatgagtcagaggaacaacattctgcaaagataccaaaacttgaccttgatccccatcaaaactcagagcttccatctgctgggtatgctctccctctgtttgttcctgaacccaacaccaaaatcctgtcagcagcattttctgaatcctcacctgccacctccagatttcccaaagaaatgggaagctatttcagcttgtcacagtggcaggagctggagctgcaggctttgatattcaggtacatggtggccggtgcggctgttcctccggagcttcttcagccaatcaggaaaagcctccattctgctccttatttcctccaccaccctctccaacagttccctcaccttcaacctgctttgttgcaatcagggtattggggaagagctgccatggatccggagccaacgaggtgcaggaggacagatgggaagaaatggcggtgctcgagagatgtggttgcaggtcaaaagtactgtgagcgccatg

SEQ ID NO: 9973 - DNA, 522 bp, Malus x domestica
  Predicted polypeptide sequence is orthologous to G1863, G2334
acaatgcaagaagcaatgctagctcaatgaactcggccaccagcctctccatttcgatacgtggaactacctcatcggatgtgtcgttgaaattgtctactggcaatggggtcgagccaggccaccaggacagccatgctgagcgtgggcaaccacatttgaattggccagccgggtgggcaacaaaccaaatggcttccatgggaggaccacttgcagaggccctgcggtcctcttccaactccaattcgtcgtcgccaaccagcgtcttacatcggttgccccgcgcctctgcctccgaagctagcttcatcagcacttgaattatcatccgtatcagacagttccggcaagcttcttatagttgcttgtgtaaatcgctctcattattttactttaactggacgagttctgtgtatgttttaaccaaaacaaatttaacactcattatctcgtaaatgtgcaattgcaattcacttttcaagttaaggtgattctcaaaaaaaaaaaaaaaaaatcgtg

SEQ ID NO: 9974 - DNA, 318 bp, Malus x domestica
  Predicted polypeptide sequence is orthologous to G1884
agaattgacaatggcactctcagatcttgtttgggaggatatgacagcaggtccggttggtacgcagaggactgctgttccttataccgagtaatcagatcaggaggcagaaggaaggcgtgttctcgcatctaagctgcctcattgatcattacccctggtgttacaaatgctttgtccatgctccatctttggtttctttgtttatgaagatggagagaaaatgattgaataaaatacttcagaaacttttcttggaatgaaaatcttttagcagaagatatattggaaaatatgggaaaaaaaaaaaaaaaaaag

SEQ ID NO: 9975 - DNA, 456 bp, Malus x domestica
  Predicted polypeptide sequence is orthologous to G1884
ggatatttcaaggaattcacaagctgaccaacaatattacttttttacgatacatgaacaagattgggactacaaagtggaagccctgaaaaattccgttctgaaatcggagctctctcgccagtgattcgatcagttggcattggttgcagacccatttgtcatacacacttattggttgtagacccatttgtcgaggctcaaagaaaaagaagggggaaaagtgtattcttgccatagattttctgttggcagtgagccttgaagaaaagggaaggtgattacagcggatgaggtggctttttgcttttggccttttgttttcttcattttgctaaatgtggagacttgagaaaagaacttctaatgttgaaccccaattcgatgtgaaaacataacctaatcatgttagcatacaaacttgattgttattttgttcacaaaaaaaaaaaaaaa

SEQ ID NO: 9976 - DNA, 622 bp, Malus x domestica
  Predicted polypeptide sequence is orthologous to G189
caggtagaattagcaactataagaacaagagaaagtccttatggaagatagatttaccagtcgtagcctatgccttcgtctttcgatgatcagacctaagaaaggcggcctaattccgatcaaaaaaagagagaaattcccccagaaagggtagagccttagttacccgcaggtcataagctggtaaccagtggaagagcaagaactttcaggtgaaagaccctcactcgaactcagtaggaagccaagcacgcacgaaagaagcttcccgagctgctgcctttaccttcttcctggggaggggtctctagcacattataatgcgagctcggatgcggattcccttaaattagatttcgtgagattagatgggctgggctatgtcttcggtctggatgaatgcgagtgcacgaaaggtctgatcggctcataggtggaagacactaccttgaattagctcttttcctctttctttttcacaagcatgagtaggacttatagtcttggaaaagtcacccgactaagcaaagaaggaggacctagttaaggaagaatcgaccgaagtcagagaaagtgagccagccttccggaaacggtgaattcataatataatgtccttctt

SEQ ID NO: 9977 - DNA, 583 bp, Malus x domestica
  Predicted polypeptide sequence is orthologous to G19
tgagagggctcttttttctctctaagtttctacaagtggcaatataaacatgtgtggtggtgctatcatttccgacttcatcgccgtcaagcgcgccctgaagctgacggcggaggacctctggtcagatcttgacaccatctctgacctccttggcatagactactccaacagcatcaacaaacagccggagaatcacaaggtggtccaaaagccgaaaccatctatcaccaaagtgacaagtgatgagaagcccaagcaggcaagcgggtctgctgctgccgcaaaaggcaagagagtgaggaaaaacgtgtacagaggaataaggcagaggccgtggggcaaatgggcggctgagattcgcgacccctacaaaggcgtccgggtctggctcggcacctatgacaccgctgaggaagccgcccgcgcttacgatgaagccgccgtgcgcatccgcggggacaaggccaagctcaactttgcccaaccaccatcctcttcaccgcttccatctctggcgccggatacgccgccgccgacaaagaggcggtgcattgttgctgagtcaactcgggtggagccg

SEQ ID NO: 9978 - DNA, 815 bp, Malus x domestica
  Predicted polypeptide sequence is orthologous to G19
atgagaaagctcttttttctctcaaagtttctacaagaggcaacataaacatgtgtggtggtgctatcatttccgacttcatcgccgccaagcgtggccggaagctgacggagaaggacctctggtcggagcttgacaccatctctgacctcctcggcatagaccactccaacagcatcaacaaacagcctgaggattacaaggtggtccagaagcccaaaccatcagtcaccaaagcgacaagtgatgcgaagcccaagaaggccaccggggcagctgccgctgctgctgcagaaggcaagagagtgaggaaaaatgtgtacagaggaataaggcagaggccgtggggcaaatgggcggctgagattcgcgacccccgcaaaggcgtccgagtctggctcggcacctacaacaccgccgaggaagccgcccgcgcctacgacgaagctgccgtgcgcatccgcggcgacaaggccaagctcaacttttcacaaccaccaccctcttcactgcttccacctctggctccggctacgccgccgccgacaaagaagcggtgcattgttgctgaatcaactcgggtggagtcgactcaaccgagtttccacaccggttcttactattatgatacattttatcagggtgacggtgaatatgtatgctaaaaaatgagggggccgaaggtgacggaaggggtatgtaccataaggaccaaataatcgaagcttggaagtattttattttgaggtctgggaaaaaaggtggtggacaaggaatcacaacccaaccccaagcccggcttattacttcaaata

SEQ ID NO: 9979 - DNA, 576 bp, Malus x domestica
  Predicted polypeptide sequence is orthologous to G1917, G383
ttttttttttcaattctaagcaaaaccagtttcagaaaacccatttaaaaaatccaacttttactcgaatcccattgaaaaaaggaagaaaaatagaatagaaaaaaaaaaaaaaaccatgcataggtgcagtagtggctcttcacatggcggcaacatggtcggcggtccatgttcgtgcggtgtccttcaccatacccaatccaactcctccttctccatgctcttctccatgcctaatcaccacaagccgtacaatcatattcatcacgaaacatcgtacgatcatcatcacatgtacccgttcgcatccccatcgtcctccgtcgattgcactctctccctaggaactccctcgacccgtttgaccgaaaacgacgccgtttccgacgacaggcgtgcgcgcaacggcgagcggcgctccggtaactgcgtttccaacttctgctgggacttgttgcagcccaataagtcatctccgtcttcccatcacaaaacccccagccgcggtggcaatttcaacggcgttactaacgctgttagtggtaataacgatcccccttctcgctcgacgct

SEQ ID NO: 9980 - DNA, 704 bp, Malus x domestica
  Predicted polypeptide sequence is orthologous to G194
agcaatgaagaagaagaacatcatgagcaacaaaagaccaagaaagagttgaaagcaaagaagacgagtcagaaaaggccgagagaacccagatttgcattcatgacaaagagcgaagttgatcatctggaagatggctacagatggagaaagtacggccaaaaagctgtcaaaaatagcccctttcccaggagttactatcggtgcacaagtgcatcatgtaatgtgaagaagcgagtggagcgatctttcgacgatccgagcattgttgtaactacttatgaaggccaacacactcatcgcagcccactcctgcctcgcccaactctccctgcggcttctgcttttccagctaataactttgagatgccattaatccccacaagaaccctatttactcatgactatcaacaagtacaaccatttgcagataacaactcctcttcgccttcatcggcaccaattaattttggtgattattatgtgaatggctcttcattgtttacaaatgctactagtaccacgggctttcttcatcccgaaaggcggttttgctctccggcaaccggttctgctttgttagctgaccatggccttcttcaagacatagtcccctctcatatgctgaagcaagagtagaagatatatacccttatatatatatatgatcatcatcagatagtgagatcattccaatccatcag

SEQ ID NO: 9981 - DNA, 682 bp, Malus x domestica
  Predicted polypeptide sequence is orthologous to G194
aaagagcgaagttgatcatctggaagatggctacagatggagaaagtacggccagaaagctgtcaaaaatagcccctttcccaggagttactatcggtgtacaagtgcatcatgtaacgtgaagaaacgagtggagcgatctttcgacgatccgagcattgttgtgactacttatgaaggccaacacactcatccgagcccactcttgcctcgcccaactctcacttcagcttcttctgttgcttctgcttctccttttgcacctaataattttgccatgccattaatccccacaagaaccctatttcctcatcactatcaacaagtagagccgtttgcagataactcctctccaccttcatcagcaccttttaattttggtaattatcatgtgaacggctcttcgtcgtctctaacaaatgctactagtactaccaccggccttgttcatcccgaaaggcggttttactctccagcaaccggttctgctttgttagctgaccatggccttcttcaagacatagtcccctctcatatgcttaagcaagagcagtagatgtatgcccatatatatatatatatatatatatatagacataaagatatggatattatcatcatgagatagtgagatcctcccattagagctacttaattatgtactaatttagcttgcttactg

SEQ ID NO: 9982 - DNA, 466 bp, Malus x domestica
  Predicted polypeptide sequence is orthologous to G1944
ttttttttttgatcgagaaagatgagtgaatacgtctcaaacaacttcaaatcacattacatcaatccaaggaaaggcagattcggtcgctaatattacatgatcaaactactctagatgtcacaacaggctgccgaagcagcactaaaagccttcctacgcggctaaattaaagaacacctcaaatggggttgaaccctgcgacgatactagcagtcaagtttacagacaacaacaaacaaggacaagtgagatccaacggttgggaataggggagcttaattgccaatgtggtcagtgagaaacctcatattgcaactagaagcacttactcttcacattacacctcccggcaaagatacattaatgtcagtcttgttttttggatctgatgccaatgacgaccaattatctccacggaaggcagtcgaggatgagaagtttgattttgggtcggcacttgaaa

SEQ ID NO: 9983 - DNA, 551 bp, Malus x domestica
  misc_feature (436)..(436): n is a, c, g, or t
  misc_feature (445)..(445): n is a, c, g, or t
  Predicted polypeptide sequence is orthologous to G1944
gcgtttctttggcaagtccagatgggcgtgttgtaggtggtggagtggctggtctgttagtagctgcaagtcctgtgcaggttgtagttggcagttttctatcgggaaaccagcatgagcagaagcccaagaagcagaaacacgattacatctctaatgcaacaccaactatggctgttcctatttcgagcgctgaaccaaaaccaaacttctcatcctcaacttctttccgtggagataattggtcttcactgccatcagattcaaaaaacaagactgacattaatgtatcgttgccaggaggcgtaatgtgaagagtgtgcttttaattgcaatatgaggtttgtcactgaccacattggcaattaagctccctagtcccaactgttggatctctcacctgtacttgtttgtctgtaaacttgttgactgctangtatcgtcntgggggtttcccccgtttgaggtgttatttaatttagccacgtaggtagtaatctagcgctgcttcggtagcctgttgtgacatctagagtagtttgatcgtgtaa

SEQ ID NO: 9984 - DNA, 571 bp, Malus x domestica
  Predicted polypeptide sequence is orthologous to G1950
ccgctccctcctccacgtcgctgtctcttcaggtcgctccgaggtgatgaagctgctgattgatgctgatgaatcaacgagtgtgataaacagcacggatgaagatggatgggcgccgcttcattctgcggccagcattgggaattcagaaatagttgagctgttgctaagcaaaggagctgatgttaatttaaaaaacaattgcggtcgatctgcccttcattatgctgccagtaagggatggtttgaggttgctcagagtttgatctcccatggggcaaaggttaatctgaaggacaaggttggttgcaccccattgcaccgggcagctagcactgcaaaatcacaactgtgtgagcttttaattgaggaaggggcagaggttgatgctattgatagagctggtcagactcctcttatgggtgcggtgatttgcgataacaaagaggtttgtctccttctaataaggcacggagcggacgtggacgtggaaaacaaggaaagatacacggtgcttggtcgagcttctaaagaatttagaccacttttgatcgacgctgctaaaggcatt

SEQ ID NO: 9985 - DNA, 459 bp, Malus x domestica
  Predicted polypeptide sequence is orthologous to G1950
ttttttttttttttttttttttttttttttatttcaaatcaatcgtacatttattactgcgttatcaacacaaaataccgtcacgttgacgttacaacgtaggtttagctccgtgataggcgtttatttcccggctaaactcgctctttttcatgacgcaagggttgaaaaaagcagggtggttcttgaagttgaaacggtccaaattggtgggaacaattccctccaagctcttcacattggcccgagctccatgagcaaccagcaacagagccacctccacgtgccccgcctccgccgcgcagtgcagcggcgtgtaactggcatcgtccacggcatccaccagagcaccatgattaagcaacaccttcacacactcgatcctccctttgaacgccgccctgtgcaaaggggtccagccattctggtccctcccgttcacctctgccccctccgcaa

SEQ ID NO: 9986 - DNA, 644 bp, Malus x domestica
  Predicted polypeptide sequence is orthologous to G2
cttcaatctcaagtcccagctgaaatgcataaatatgggcagttcagtagtaggaggcctactgccgaagacattcaaatgcctcacaatttcccaccacatttcaactcaccaaattatcatcatattcagtttccgagcagcagtgaaggagggggccgcattggcagtgatctttcactgtcaatgagcgaccaccaccaacaatggcaatccgctactccgacctccgatttatttgcaactgctgcagcatcatcaggattcccaccacaaattagaccgtcgtacacacaaaacggctggctgcagaaaaatgggttccactctctcaccagacgctaattaaagctagcttagctctctttggtcatgaccccttttaatcaagatttttctgcctaattaccaccatcatcccccacctccccgattctaatttattacgatcaagtcctcttgattctgtttattttgtaagcaccaaaaatccagttctttcagtgctccaaaacatagacaaattttagtaacaaggacaggaaattctcctattttttggagaaatgaaatcaaatgtatgctctcattggtgtttaccaaaacaaaaaaagaacaatacttgactatttaaagatgagtag

SEQ ID NO: 9987 - DNA, 2234 bp, Malus x domestica
  Predicted polypeptide sequence is orthologous to G2
ggcagtttagtcgccactccaacacaagatcctgcatcacctccactctctctctctctagctccatagctcgtccttatagctctcctctctttctctctctaacttttttcctcttcggggagtttccttgttcaagttgatgcctttttgccacgctgaattctgagtttgatgtaaaaaacgaaaccgacacttaaccagacagctggtaggcaagcgagagacagggaagataaaaaaaaaatgtgggatctcaatgactcgcctgatcagcggccacgtggcgaggaatctgaaggctgctcctcccagaagacctccgccgacggagacgaggaaaagaggaaacgggtcggatccgtgtccaattcaagctcgtcggcggtggtcatcgaggaggacggatcagaccaagaggaagatcaggacgacgggcccaccaagctggccaagaagcaaggaggaggtgggggaaagatattcgggttctccgtggcccacgaggagtccatggatagtgatccgcccgcgaccgtcaccagacagttctttccggtagagctagactattcctcctcctctaatcttgacgtaatggggcccgcagagggcggcggtagcatcccaccacctccttctacatcgtcgtcgtttccccgagcccactgggttggggtcaatttcgggcagtcggattcgggcagccccggaaatccgccgcccgccggggaggcctcccaccagcccatgaagaagagccggcgtgggccccgctccaggaactcccagtaccggggtgttacgttttaccggaggactggccgttgggagtctcatatttgggattgtgggaagcaagtttatcttggtggatttgacacagcgcatgcagctgctcgggcgtacgacagggcggcgatcgagttccggggagtggaggcggacataaattttagcatagaggattatgaagaagacttgaagcagatgaggaatttaacgaaggaggaatttgtgcatgtacttcgccgacaaagcaccgggttcccgagagggagctctaaatatagaggggtcaccttgcacaagtgtggcagatgggaggccaggatgggccaatttttaggcaaaacatacgtttatctgggattgtttgacactgaggttgacgctgcaagggcttatgacaaagcagcaatcaagtgtaatggcaaagaagctgtcacaaactttgatcccagcatctacgataacgaactcaactcctctgaatcatcgggtgttattgctgcggatcacaatctcgatttgagtttgggtagcacaaactcaaagaaaaacaatcaagcattagggaatgatcatcatagccaaaatgttgcaatggaacaccagcattctgtctcgatgcaacttgatgccaattggaggagtcaaggacttcggcctaagcttaacatacaacgagatcgatcaagagacgacattgatgctcagagaagagacgggtactcggagagtgaagccatgcagcttctactccgaacaaaccttcaatctcaagccccagctgaagtacataaatatgggcagttcaacaggaggcttactgctggagacattcaaatgtctcacaatttcccaccaaatttcaactcaccaaattatcatcatattcagtttccgagcagcagcgaaggaggcggccgcattggcagtgatctttcactgtcaacgagcgaccaccaacaacaatggcaatccgcaactccgacctccaatttatttgcaaccgctgcagcatcatcaggattcccaccacaacttagaccgttgcccacgcaaaacagctggctgcagaaaaatgggttccacactctcgccagacgctaattacgctagcttagctctttgatcatgacctcttaatcaagatttttctgcatctccacgtccccgattcttgttaattacgatcagtcctcttgattatgtttattttgtaagcaccaaatcggcaagtctagttctttcagagccccaagtcaaagattttagaacaaggacgggaaattctcctagtttgtgggaaatgaaatcaaatgcatgctctctttggtgttttaccaaaaacaaaatgtatggtcattttgtccaactaacaaatgaatggagtagatcttcaactagattttctgattctgacgacaaaaaaaaaaaaaaaaaaaaaa

SEQ ID NO: 9988 - DNA, 656 bp, Malus x domestica
  misc_feature (628)..(628): n is a, c, g, or t
  Predicted polypeptide sequence is orthologous to G2057
ctcgactttcctcccaccgtcgctcgactcggacgccattgcagacaccataaagtcctttttcccaacgggtgcttccgcaatcgcagccgcagccgaggctccgtcgtcgacgatacagtttcatcagaactacccacctgatttactctccagaaccagcagccagagccaagatctgcgcctctctctgcaatccttccaagacccaattctcctccaccagcaccacgctcagacccatcaaaacgagcaatcccttttctccggatcccaaaacccgcttgggtttgatgggtcctccgccgcgtgggcagagcatcaccacaaccagcagcagcaagagatgaacagattccagagaatggtggcttggaacagcggaggcggagatagcggtgataacggcggtggatcatcgtcgtcaggcgggtttacattcaactcgctgctaccaacacagcagagtggtactagttctttgcagcagcagcagccgtcgttgttcggccaaagccagttcttttttcagaggggaccccttcagtccagtaactcgccgtcaatccgtgcttggatgatggaccagcaaaaccaacaatccatttctcacgatcatcatcatcanatctcgcaatccattcatcaccaaccgt

SEQ ID NO: 9989 - DNA, 681 bp, Malus x domestica
  Predicted polypeptide sequence is orthologous to G2057
ccaaagtcagttcttttctcagaggggaccccttcagtccagtaactcgccgtcagttcgtgcttggatggtggaccagcaaaaccaacaatccatttctcacgaccatcatcatcaaatctcgcaatccattcatcaccaacagtccatttccggcatgggattcgcctccggaggcggattctccgggttccacatcccggcacgaattcacggcgaggaggagcacgacggtacttccgacaagccgtcctctgcttcctccaattctcgccattgaaccaaagaaatggactgaacttctcttcaaaagggctcaagctctcatctcatctctgccttccacagagagattacaagagctacctgttggtttccaattcatatatggccaggagacgatttttcggtcgctttgttcaatggcgtgcgccttgggaagaagaaatctgagtgcattttcgggtttttatcgatccctcggttcgttttagcttttatttcatcagtttgttgcttcttgttttagaagttctgttttcacgtttgagatgagctctcaaagctcaaactttttgcttgttctatgttggatttgtgtttctgttgctagactagcagtatgttgctaaatttgacttgtttcattcctagagttaaaaaaaaaaaaaaaaaatcggt

SEQ ID NO: 9990 - DNA, 473 bp, Malus x domestica
  Predicted polypeptide sequence is orthologous to G2094
cgggatcagaagcacgaagaagaggacagctattttgggattaaacaaagaaaatcccaacgataaaaagggcaagaagaacaagcagctcggcgacggcttgaagcagcggctgttggctttgggaagagaggttttgatgcagcgatcgacggtggagaggcagcagaggaagctcggcgaggaagaacaagcggcggtgctgctgatggccctctcatatggctctgtctatgcttagcctatgttcggattaatattaagctataagtaataagtaattaattagggagaaatggcaattctaacctccatttttcagtgtaatttcacccccacccctcccgttttcttgcctcttttattagtggaaatttactttgttctttatttttgagagtgattgagcaaatgtaagaattttggaagatcttgttctaattttgctgacataattctactaaaaaaaaaaa

SEQ ID NO: 9991 - DNA, 619 bp, Malus x domestica
  Predicted polypeptide sequence is orthologous to G2094
ttttgttcgctcttttttcactgtgctttttcgaaaagctgctataagcactttcggtctcagcttctgagttgtgatcgatctctttccttcttgttcctctgtttttttccatagcttgggttcgctgagtcactaaagtttcttacttgaccagaaaccattcgatcaaattgatcgctacccagttcgatttcctactcgttctcaactgggtttgtctcagatcttcataatatctcatacagaatgttggatccaatcgataaaggatcggagtcagaggaaatgactatcaaaaccccagatgccggttcctcggaggaaggctttaagaaaacctgcgccgactgtggaacctccaaaacccctctgtggagaggcggtccggcgggcccaaagtctctctgtaatgcgtgcgggatcagaagcaggaagaagaggagggctattttgggattaaacaaagaaaatcccaacgataaaaggggcaagaagaacaagcagctcggcgacggcttgaagcagcggctgttggctttgggaagagaggttttgatgcagcgatcgacggtggagaggcagcagaggaagctcggcgaggaagaacaagcggcgg

SEQ ID NO: 9992 - DNA, 495 bp, Malus x domestica
  Predicted polypeptide sequence is orthologous to G21
ggttttgcttatctcaatttccctgaattggctcaagcacttccccagccagactccaagtctccaaaggacatccaagctgctgctgccaaggcagctgctgcttctgcttctgaggataagcagcttatatgtgaagcagaaactaaagaagcggagcccaagatccctatatcaacaaattcaaccttgtccaatgctcaagaatcaagtagcacttgtgcttctggttcaacagattacgatgatgagaaattgtttgacctaccagatcttttcatggatgggaaagatggaagtgatattttttgcaattattcttcttcaacttggcatttgtgtgcagctgacactggattcaggctaggggacccattcttatgggagtattagttagccagtacagattaaggactgtatttttctcttttttatttaatttatttttatcaaacataaataattaagtttcaaaaaaaaaaaaaaaaaatcggt

SEQ ID NO: 9993 - DNA, 653 bp, Malus x domestica
  Predicted polypeptide sequence is orthologous to G2116
ccatgatcaaccgatccaaggccgaggccaaggccaggttcaaggctaaggccaaggccaagtcgaagtccctagccggacgaggatccggatcctggcaggggaagattccaggccaaccgacgaagcccggagatggccctcctactcaactcaaaaatgaaaaggctgttgaaaagaatctggctaaagtccagcttgacaaggagaatactactactccaaaaccaaaaccagaaaagagaaagagcagaatgggtagaactttcctattcacagacccttgtcgaatttgcaatgtgtttgggcactggactgatttatgcccctacctgaaatttgtcccatacaacgtaactaaggttggcaagggctatgaaatacatgacggccgccatgggaggtatgctgctccgatttattgtcttaactgtacggtgccggttgaacacgaggctgaaaagtgcccgtacgacagctgatgcatggcagtaatccagggccatcatggttcgcctccttccacccccataatcttgccgatggcgaggaaggtgttggattatctagtcttggggtgttgctttcctctttacttgctttgagtttcagcactctgtagtctgtacgtatgtctttgagtaagctcaccc

SEQ ID NO: 9994 - DNA, 524 bp, Malus x domestica
  Predicted polypeptide sequence is orthologous to G2144
ccatccacgtcatgatgcgttaaccgagggttgttccgtggtttttacatagttggtatctttggattgtgcgagtgtcactcctttgcgagatagacctgtagctttagctcctcaatgcccatgcttgtctcctcgacattcagatgcttctgaagaggcaggagatgaaggtgactcgcacgaagatggatttattttgcagcagcgttaacaagtttcaaacaagcgaccatttgaggatgctcaggctgacagtgatgtcaattttcgtcacaagaagaaagaagtgtttagacctcctcaattcgatgaccgtgcgccatttgagagagatgtatgtactttattttctctcatgatttcttctgcttttatgattttggcttttgtttctaacatctttctttggtgtctttacgttgggccttcctatcattttgatttggcaattgcagatgtttattcctatacggagatgctatttataggcggcctaccttacagatagagagatcggggat

SEQ ID NO: 9995 - DNA, 491 bp, Malus x domestica
  Predicted polypeptide sequence is orthologous to G2144
cgtggcttgaccgcgacgagctcgaacatgaacgtacggcatcttctcggcgtcctctttgatttcggtcttgcacttcttcgtcggggccttaatctgaatttcacaaagtcagaggggttcaattcgaattttatcgatcacttcgaaaattcagcaaaatttccgaaaagggaatcctagaaaccctaattcgacgggaattaccttcttctctcgctcctttctcttacccgaggtcctctggttgtttttggtcaagtcaagcgtcagctgcgacgagctagggttcgaatcggtctcggccggctcggtcttcaccttctccaattcggcgccggagttcgacagcgcggagtttgtatccggcgagccatctccggcgaaggtcgagaacttggcggcgcgttcgattggggcggggttggtagggaaggggaggctcgaattgaaaggaaggtgctggacgaagggcgcgtgttgggggtcgc

SEQ ID NO: 9996 - DNA, 625 bp, Malus x domestica
  Predicted polypeptide sequence is orthologous to G2144
ctcagacaactcaaagaaataacattttgaccgccatagccatctctctctctctctctctctctctctctctctctctatatatatatatatatatatgtatacccacttgcccaatttgcccaaattgcctagctttacccatttctctctcacacccaatttcagtcacaaagaccactgttcttcccgagaccttaatcaaattaccgggcttttgcttaattgatacctacactttgtccgagttgagaactttgagaaatttgtcacggaattgagctctgtttcagttcaatttgccgcccaattcaatggacccaaccggagcaaccgtacccgaatccactttaccgggacccgagctcgagtccctccaattccgggaagaaattcaccaactcatgaccgtgccgcccgagaacgccagctccttcaccgcgcttctagaacttccgccgacccaagccatggagctcctccacctctcgccggaacccgactgtgctccgccgctggccggcgtctccgccgacccccaacacacgccctacgtccagcagccccctttcaattccagcctaaattttccctaccaattccgctctaaccgaacgcaccgcca

SEQ ID NO: 9997 - DNA, 618 bp, Malus x domestica
  Predicted polypeptide sequence is orthologous to G2144
ttggttctagatgaaatcatcagtcacgtgcagtccctacaacgtcaagttgagatcttatcaatgagacttgcagcagtcaacccgagaattgatttcaactttgatggtctattggttgctgaaagtggatctctgatggaaagtaacttcgccggtatggttacacctctgatgtgtccggaagtcccaatcaataggaacagacaaccgtatcaacagcaatggcactttgatgcgcttcagcagcaaggttgggggcgggaagaagaaaatcacactttcattaccccagaaccctcctcatcagttggggctgttcagcaaactcagcaactgcagacaagtcacctggagatggagatgtgaagacgtaattaagttgtactagtagaaatgtgtatataaagtatagtattagcagttagcaggtagtagatgaaatgtctcggtattcatggccgagtttctttgttctctatttttcagggtcagttaagaacatcccgatttgcctcgcttcgagaggaaatagatttggtatgttatccggataagtatatatatacactaactctgagggtcattcaatctaattacctattttttggaactgat

SEQ ID NO: 9998 - DNA, 610 bp, Malus x domestica
  Predicted polypeptide sequence is orthologous to G217
atatccagaaggcagcaagcattgagaacaaggttaaagttcgcacatatggttatgagatgcgggctaaagagggtctctggccaaaaattgaggaaacgtttaagcagatcgacactgctgcaaaagaacttgagtgctttaaagctttacagaagcaagaaagattagcggcaacacaccggataaataatatctgggaggaagttcagaatcaaaaggagcttgagcggcaactacagaagcggtatggcaatcttgtagctgaggtggaaaggggacagcagcgcatggatgaactcagagcagaagcagaaaaacaagaaattgcagccaggaattctgatctggagttggctgaggctacagcaaatgtgactgttcaacagacaactgaaaatcctgatcatgtaactgcttcagacgagcctggaaatgctgttcccggtggtgcatctcatgttgaaggaacaaatcaacaaatggatggtgtgcaagaacaggcttcaacaggcccagaaggtgatatggacaatgatgccaaaaaggttcatgcgacgccagcggatgatgtaaacttacctgataacatgccttctgctgttgaggg

SEQ ID NO: 9999 - DNA, 507 bp, Malus x domestica
  Predicted polypeptide sequence is orthologous to G2213
tttccttttctcaacctttggtttccgatcttctcatctttctcatttttctcagccaaatcatctgtgcaaatttcttgcgtttaaaacccttggaaaaataaatagttgctgcatcttgcgtttaaaatccctgggttagtactgattttgttggtttttcgactttatcagggtagatttgttacctccaaggtccacctctgtttggtggacactttgctcttcgttttttggggcttctatgtgcagcttcgaacccgtttatgctcaagaccataatttttaagcaacaaaattaagctggaaattaaattgaggtatgaatgcttccacttattcagcttccaggatctacagttgccatgcctttgatggataaaacatggaggacccagctactactcttatagagcttctttagcattgtaatgccattcagagtggttcaaagaatttcaagagcttcattcatctaatttatgcttttcatgtaaaaattaattc

SEQ ID NO: 10000 - DNA, 688 bp, Malus x domestica
  Predicted polypeptide sequence is orthologous to G2226
taaaacaaaatatatatttatatgctgattgtgtgtgtgtgacagctgcctaaaatccctagaatcccttcttcttcttcttccttcagctcctctggtcggtactctgtttttataaggactgaaaaagcttaaaagctccaaaagtcttcactctgtcggataacaccaagatatcggtgacatttcaacttcgtttgaattaatctgtctcccgtttcgtgtctttgccggttcattctggtttcactgtccctcaacaatcttttactgattttagctttgagtttggatattccggtgtttaccatacatttatattcacaaatccgaacccccataacatcggttttgttcaaatgggtctctcaagtctaccagctccatcagaaggagttctatgtgtgcttttagtaaacacagccctatcagtctccattatcaaggggataatccgatcagtcctgcaagtcgttggtatccgtctcacatcagcctcgtcatcttctttcccatcagaagactctgctgaaaacctctcagaatcatttgagttccatgtcaatccttcggctagttacattgaggacatcaggagccatatcccagcaattcggtttgatgctgtgtgtagcttcaagcagcaggaacacgaatgctctgtctgcctaaccgagtttgaacctga

SEQ ID NO: 10001 - DNA, 722 bp, Malus x domestica
  Predicted polypeptide sequence is orthologous to G2226
gtttcgcgtctctgccggttcaatctggttccactgccccttacaatcttggcaatccgattcgagccagtggaacttagtagttttgatcacatagaggtctctctagtctaccagctccatcagaaggtgttctatgtagtgcttttagtaaacactgccttatcagtctccattatcaaagggataatccgatcagtcctgcaattaggttggtatccgtctctcatcatcttccccgccgttagcagactcctctgaaaacctctcagaatcatttgagtttcatgtcagtccctcggctacttacattgaggagatcaggagcagtatcccagcaattcagttcgaatctgtgtgtagcttcgagcagcgggaacacgaatgctcagtctgcctaaccgagtttgaacctgaatcgaagatcaaccacttgtcctgcggccatattttccatcaaaattgcttcagagaagtggttgaattactggaacatcacatgccctctttgtaggactcctttcatgcccgaggaggacgcaccctgcttctgggtgaagggtttacaaagcaagaaaatcgcgatgaatgtcatgtacagcgtttaatgtacaggtatttgacaagaatgcatcgcctgccattagtgttgttaactatgttatgtgcgagttaaaccgtggtatatgtccatcagtctcagagaccacatttttactatg

SEQ ID NO: 10002 - DNA, 529 bp, Malus x domestica
  Predicted polypeptide sequence is orthologous to G2239
ctcggcggcggagagagatgaccaggtaatgctagaacgaccacaacaagaacctgagctgttgaacttaaaccagacgctgaatcggaaccgtacacgcggatcgagatcaagcaggttgcttagattgttcccgcggtcgcactcgaccggacactctcttgtccaaccgggagaagacactgagcggttcaccttgagactaccggttgaagtgagaaaacagatcatgaatcggaagctgaaccggtccactagcttgttggtcttgccccgagaagggagttcgaggcgtggtcctcgaaccggcgagagtggcagtactaatagagtgaggagctacagaaggctcgagccattggaccggcaattcaaatcggaccggtgggtgttctccaaaacgccgacgtttctcacgaggatgtcgagtctcttgtcgccaaaggtggcggtaagtgacggcgagaagccgaccgagccagcgatgtcgaggagtagctccgctcggcctccggtttaattagttttg

SEQ ID NO: 10003 - DNA, 507 bp, Malus x domestica
  Predicted polypeptide sequence is orthologous to G227, G242
cgttgctgtcggctcctccatgtccgaagatttgtgctccgacgtccatgaccacccgccacacaaaagatccgccagcgtcggtgccgtttcgggtacgggtctctattttaacccgggtagcccgtccggatccgatttgagcgattctagcttgcacggcggtgtctctccctcgtctcaggtcttcaccccccttgcgagacccgtatctcctcccattgctccgccgccgatggaggccgcgacatcagctgtggccgttgatccacccacctcgctcagcctctcgcttcccggatccgagtcggagtcgtgtgacgggtcgaatcatatggggtccggattcggatccaatccgattgttggtcccacccaaatggtagagcaaccacatgaggtagcagctccaccgccggtggtaggattgctgccgccgccgcgttcgagcaatttgaacaacaatcagcagtttttcagctcggagttcctggatgtgatgcagga

SEQ ID NO: 10004 - DNA, 624 bp, Malus x domestica
  Predicted polypeptide sequence is orthologous to G227, G242
actggtcgctgatcagcaagtcgattcccggtagatccggcaagtcttgccgtctgcggtggtgcaaccaactttctccggaggtggagcaccgccccttcagtcctgaagaggacgacaccataatccgggcccacgcccggttcggaaacaagtgggccaccatcgcccggctgctcaacggccggaccgataacgccataaagaaccactggaactccacgcttaagcgcaaaagctcctccatgtcggaagatttgagctccgacgtccaggcccacccgccgcacaaacgatccgccagcgtcggcgccgttccggttacgggtctctatttcaaccccggtagcccgtccggatccgatttgagcgattcgagcttgcccggcggtgtgtctccgtcgtctcaagttttcactccctttgcgagacccctacctccacccattgctctgccgccgatggaggccgtgacatcggctatggccgttgatccgcccacatcgctcagcctttcccttcccggatccgaatcgtgtgatgggtcgagtcatatggcgtccggattcggaaccaattcgattgtcgggcccgcccagattgtacagcaagcgccagaggtaa

SEQ ID NO: 10005 - DNA, 649 bp, Malus x domestica
  Predicted polypeptide sequence is orthologous to G227, G242
cactagaaactctcaactttcaaatttcaaaggattacagagaaattcaaatttaaaagaaaaaaaaaagaagattaaggggagagaaagagtctgtgagttaattgcgatggcggtgagcagaaaagatatggatcggatcaagggtccatggagccccgaggaggacgactccctgcagaagctggtgcagaagcacggccccaggaactggtcgctgatcagcaagtccattcccggtcggtcagggaaatcgtgccggctgcggtggtgtaaccagctgtcgccacaggtggagcaccgggctttcacgcctgaggaggacgacatgatcatccaggcccacgctcggtttgggaacaagtgggccaccatcgcccgcctcctcaacggccggaccgacaacgctatcaagaaccactggaactccaccctcaagcggaagtgctccgacggcgggggcgtcgatttgaatggagggtacgatggtcattttctccgtgaccacgagcaaccgccgctgtaccggtcggttattgctcggtcgggcgtgccagtttcaacagggttttacttgaccccgggataatcctgtatggggccgaatcctaccaccgccaactccctacccatgccccccctccacctc

SEQ ID NO: 10006 - DNA, 372 bp, Malus x domestica
  Predicted polypeptide sequence is orthologous to G2290
cgttgctgtcgaatttccctaagaacctatgtatgtgctgaggagccgccctcttagatttccagagattggatattgtgccaggctgtagttattttgctgcaaggaaactcaagatattcggagatgcaagtgcttagtttatgacgtgtcttctacttcatctactagaagaactccacctgacggaaaatttggagtcctgctgcatcctttgttcgtatgaatagataagactataacaagagaaagaggattttcttaatgtgattataaggtattttggatatttttaatgctgaatcctttggaaaggtttgaataataaaagccgttttggccgttttagatcgcttaatccaaaaaaaaaaa

SEQ ID NO: 10007 - DNA, 577 bp, Malus x domestica
  Predicted polypeptide sequence is orthologous to G2344, G929
gaagaggagcctgtgtatgtaaatgccaagcagtaccatggtattttgagaagaagacagtcacgtgctaaagctgagcttgaaaagaaacttataaaagctcgaaagccatatcttcatgagtctcgacacctgcatgcattaaggagggcaagggggtgtggaggtcgcttccttaataaaaagaaacaagatgataacgacgaaaattcctcactagaaaagggcatgaattatgatggaaaccattcagctgaatctgccaaatctggttttgagtgctgtccaaataccagcaatgggaattttgattcctcaaatgtccagcaagacagatcaggtcaatggctcaggacacacagccaccacacacactctaatggtaatggcaatggtcatggcccatcatcagcatacccttccacgtttggtgacagcaaggaaagtgtgttcctgggtcaacagagggaaaacatgcagttgaatgggttgtctcgcggcgccatccccagtaaatgagatccctctacgaggtttgggtcccctcttgacagggtttcagttcatgtggcaagcc

SEQ ID NO: 10008 - DNA, 579 bp, Malus x domestica
  Predicted polypeptide sequence is orthologous to G2394
taggcaatgtgtggatttttggaagtcactcttctccttctgatgctcctaaactgtacaactgtattggatatgcaatgccattcatactatgtgcaacaatttgctgctgcctaccttgcatcatttctgtcctcggatttcgagaggatctttctcagactagaggagccaccgtggaatcaattaatgctctcccgacgtacaaattcaagttgaaggaaaacgagagcaatgatgatcaggagggcaacctaggtagtgaatgtggcctcttggctgcagggacagaaaaggagcgtgagatatctggagaagatgcggtttgttgtatttgcttggcaaagtatgcagatgacgatgagctacgggagctaccatgtttacatgtctttcacgtggagtgtgttgacaaatggttgaaaataaatgcatcgtgtcccctttgcaaaagtgaggccggagagagcagcggcgaggccagggactccagccaacaatagggtaagcaagatgagctcagcgatgacgttgtatatgaaagcagagattattctaaattatggaacggttaaaccc

SEQ ID NO: 10009 - DNA, 568 bp, Malus x domestica
  Predicted polypeptide sequence is orthologous to G2457
ctgtatcaggcaacccaccatcccccaaagcaccctttgttgtcaaaccacctgagaagaaacacagacttccatctgcttacaatcggttcatgaaagatgagatcaagcgaatcaaagcagccaacccagaggttccacatcgtgaggcttttagtgctgcagccaaaaattgggctaggtacattcccagtcagtcgtctgcaggatcaggttctgggagctgcagcaacaacaacgaatgaacatgctagctacgtgctgccaaaaccctaaaacgccatgactacatgggtatcatggagatcttaaataaccatatccgcagctgcttcctacctacttcatccctcattagcagttcagcgtgcgtgcaattaattaagtactctcgtttagttcgtgttcagaactttgactctccttagttttcgtttcttttgttagtgaacttaatttccgtgctaagagtactttgattggtgtatggtaatttgtattgaatcaaaatgactgatcagtattctaattttgtattatttgatgcttttattaatttaacgttttg

SEQ ID NO: 10010 - DNA, 678 bp, Malus x domestica
  Predicted polypeptide sequence is orthologous to G2457
tcattgtgtcattaggaaatcaaagattgatgaagatgacaaattaaattaagcaaagcagcgtattacttaatttaaagtcacgtagcaaaagaaaccctaataagggggacttgacaagtacaatgaagaaggatattgaaatgtccttataaagaaacaacccagtagatcagtcaaggcaattcttgtatactaagaacaactttgatatgaccgagtgtctttgcctgaaattatcgtggccatcagttattcagtagtgcagcccttgacataagatgtttctcagggtcattgtccagcttagcctgattgttggcctccaacatcagcccaaaatgaatatgagggaagtgcgcccaatttttggcagcagtgctgaaagcctctctatggctaatatctggattattagccttgatcctctgaatctcctcctttatgaactggttatatgcagaaggtacacgttgcctcttctcgggaggtcggttcacacccctttcctcagtgacatgatctgaagttgggtctctggttgcattcttcttgttgcatttggaagaggagcccaaatcaatccggtaattctgagagttatagttgtagttttgtgcctgaacatcttgccaggacggtgactgaaaggcagcggccatgttcacggaccataaa

SEQ ID NO: 10011 - DNA, 601 bp, Malus x domestica
  Predicted polypeptide sequence is orthologous to G2505
cgcattttttttttttttttttcaatcaagtgcttttgtattaaaataattaattgaaaattcacaataaattcattaagaaccagaaaaacgtccaatattttaatttctctctaaaaggaacaactataaattccttccatggctgtcgaatttggtatatttgccttaatatataaaatatgcatggttagagccattttggtttggtaattagctctaatccatattattttgcatagccccaaaaatccatctctccacgcaacgagaggtgctgggggttaatttggttgacagaagagggtgcatttgcatcctcatacctggctgctcctttggacgacgaatcttgatcatttccaaggtcatgagaagtaaccaggcggtcgagcatagcccattcactcatcccctggtgatcatgattattatctcttccgccagctgctccagctcctcctgcaaccgtattcagttgatggtttggttcgcacgtgccaacctctaacactggctcacaagcttggtaccggaggccctcactgactttcgcggtctctagggtttgtcatgagctgcttgaccatgccgtggctag

SEQ ID NO: 10012 - DNA, 690 bp, Malus x domestica
  Predicted polypeptide sequence is orthologous to G2510
agagggttctaatattgtacatggaacaaccaccatacactgaagatgaccagagcaccaccaccatcaacacccaaaaagccgactcgcaaggtggaggcacccgccacccggtgtaccgaggcgtccggaagcggaggtgggggaaatgggtgtccgaaattagggaaccgcgcatgaagtcacgcatttggctaggttctttccccgtgcccgagatggcagccaaggcctacgacgtcgccgcctactgtctcaaaggccgaaaagcacagctgaacttccccgaggacgtcgaccacttgcccaggcccgccacgagtacggctagggacattcaggcagcagcagcccaagcagcacatagagtcatcaagtcatcacacatcaccaagaaaaatgacgacgacgacgatcatcacggtggattggacggtggcgatgatttttggggagagattgagttgcctgagttgatgaacaaaagcgggtgctattggaattcatgtggctggaatatgactgcgttttcaggtgatgcagcggcggtagcatgtccggagggagaggcttgcctctgattaagaagtgttgggtgtggttggtacggccatttatgtgtacttatgtgcttgtttagatcatcaggttttcaattaaaccccacttaaaatcgagcacaactatccc

SEQ ID NO: 10013 - DNA, 726 bp, Malus x domestica
  Predicted polypeptide sequence is orthologous to G255, G664
cctggacgatgaggcagacgaggacttcgagttgttcccgcacacttcatccgtcgcaaaaaccaaaaagccagacataaaccaacaacaaaggcaacggctttttggctacaactaattattcttcttaaagctttcaacttttttccatttattttttcaaatgggaaggtctccttgctgtgagaaggctcacaccaacaaaggagcttggaccaaggaagaagacgaccgcctcattgcctacatcagagctcacggcgaaggctgctggcgttcgctgcccaaggcggcgggcctccttcgatgtgggaagagctgcaggctgcggtggatcaactaccttagacctgatctcaagcgtggcaatttcacggaagaagaagatgagctcatcatcaaactccatagcctcctcggaaacaaatggtctttgatagctggaaggctgcctgtaagaacagacaatgagataaagaactactggaacacccacataagaaggaagcttttgaccagagggattgaccccacaactcacaggccactcaatgagactcctcaggaatctgcaaacacaatttcttttgctgctgcttctgcaaatatcaaagaagatgatgaaaaaatctccataaccaatgggcttgttcgcaagcattcaacaaacccagctcaggaaaggtgccctgacttgaatcttgagcttcaatcagccctccctgc

SEQ ID NO: 10014 - DNA, 664 bp, Malus x domestica
  Predicted polypeptide sequence is orthologous to G2550
ttcagatttttttttgtgctgatctttttgccatgcacagtgtagctggcagagattgagtctaacatgtcaagtgaacactggaaggagcctctttatgcaagtatttattctttgggttttgtagcatttgctgggatctagtttcaacttaagaaactggttggcacgatttcacctctgcgaaatccatttagatgtcatgtagatttagctttaattgtataaacctgcagggtcatctgaattgttatcataaatggatgcaataagtttcttcttcccatatgattgatgcagatattggcttatttgacctttaagattgaacaaatatttggaggagtgattacaacacattgggctgttcttggccatatgcacttattgggaatttagtttacgggagttcatattacaggtttaggttattaagttacattaaagtttcattaactctcataatgtttaacattacgattattggttcattaagtgaaaaattattgggacaacagcttgatctaccatcaatatgcttatttctcttatatcatataactgattcttattgggaattattgtagggttagtttgtattggactgttggtgacaccaacacggaatcctttgtgttggtgttcccttagcatcactctggta

SEQ ID NO: 10015 - DNA, 629 bp, Malus x domestica
  Predicted polypeptide sequence is orthologous to G2604
gcagcttgtgtgctctggatgccggaaccttttactctatcctgttggagccacctctgtatgctgtgctgtttgcaatgccgtgactgctgtgccgcctcctggcacagaaatggcacagctagtctgcggaggatgccacaccctactcatgtatatccgtggagcaacgagtgttcaatgttcttgctgtcacacggtcaatctagccttggaagcaaatcaggttgcacatgtgaattgtgggaactgcaggatgctgttaatgtatcaatatggagcaagatctgtcaaatgtgcggtatgcaattttgtgacatccgttggggtcccggcaaacacccccgaacagaaattcaacaactaaaagttatcatacactactactgcaagatgctacgtacaactttgggtttgcatcttaaattacaagagttttcctccaatatttcgtctctcttagtgagaagagaaaactttcttgctccttcacatgtatagagttacgtctttttccttgcgtgaataagtagttatgtcaagatttggatctatgagaagtttctacaacaagactatgaaaatttgagtgcattattgaaaatctttggataaagatataaaaaaaa

SEQ ID NO: 10016 - DNA, 534 bp, Malus x domestica
  Predicted polypeptide sequence is orthologous to G264
gagcctttacaaacaaaaatatagctgacaacgacaaactcaaaacttcctcccaagaagccacacataacaatcaagcgcccccactggttccagttagagtaaacgatgtcttctgggaacagttcctaactgaaagacctggctgttcagagaatgaagaagcaagttctgattataggggaaatccatttgatgagcaagatgatggaaggttagaccatggaatgtccagaaatgtcgaggatgcggaaacactcactctttgagtaccagagtcgtggcgaagccctgatccaggttcacaagaaagcgctctccagtctcccttgatttataagattcaccttatataattctgaaacttgacatgaactgcctgttattgattggaatgagttcatgcaccaaattgcaattagttcatagtcatcactggctagtgttcattggcatgttagtgtattctgatatagccgcatttagcagtgtagtattgatacatacgttgtaacacaaaaaaaaaaaaaaaaa

SEQ ID NO: 10017 - DNA, 631 bp, Malus x domestica
  Predicted polypeptide sequence is orthologous to G268
aaggagttgaattgcgtggtgccgaggccgaaaggctatcagactcgaataccgtggcctcagagccgagataaggtgtggttcagtaatgtaccccatactcgactagttgatgataaaggtggtcagaattggatacgggtagaaaaagataaatttgtttttccaggaggtggaacgcagttcattcatggggcggatgaatacttgaatcagatttctgatatggttgctgacattggatttggtcacaaaactcgagttgccttagatattggttgtggagttgcgagttttggtgcctttttgatgcagcggaatgtgaccactctgtcaatagcaccaaaagatgttcatgagaatcagatacagtttgcattagagcgtggtgtacctgcaatggtggcagtatttgctactcaccgcttgttgtatccaagccaggcttttgacttgatccattgttcaagatgtagaattaattggacccgagatgatggaattttgcttctcgaggctgacaggttgctaagagcaggaggatactttgtttgggcagcacaacccgtttataaacatgaagatgccctacaagaacaatggaaagaaatggagaacctgactactcgca

SEQ ID NO: 10018 - DNA, 390 bp, Malus x domestica
  Predicted polypeptide sequence is orthologous to G268
ggagctgggggaggtttcggtggaggagctggtgctggcggtgggcttgggggtggattgccttgaagacgtacgtgtgcatgaatactctacgattcatttctccatgcacttccaaatcaaattatatatctatcttgaattactaatttagtacgtacttatgttaaggacagtcttgttgttttgtgtcaactgtaatgtgtaccatcgttgctttagcaaccaagtattttaatcgtgatgacaatgttcgaaccctaatttgttgaagacacaaagctgatcttcgtatgattgttaattacccaattgtgctaatgtatccatgcatgtgttacagtgttattataagaaacttttatctgctcaaaaaaaaaaaaaaaatgc

SEQ ID NO: 10019 - DNA, 402 bp, Malus x domestica
  Predicted polypeptide sequence is orthologous to G268
gcatccggtctcttctctattgagaaaacgaggtgtaatatttcaaccatcatgctcgagatggatcgaatgctgaggcctggcggacgcgtttacatacgtgactcagtatctgtaattgctgagcttcaagaaattgcgagcgccgttggatgggtgcctgcgctacatgacaccggagaaggaccccatgcaagctggaagatcttaatcggtgacaagcgattttgatcggattcgggtgcaaacaagtcgatgtatttttctgtaaaaggatggaaatctacccgaaatcgcaccattgaagagaaggcactgcaactaacttattgccattgttttacgctgtgtaatttgtaagattagcaagaacaaataaacaatctcgcttccttttttttg

SEQ ID NO: 10020 - DNA, 584 bp, Malus x domestica
  Predicted polypeptide sequence is orthologous to G268
atctgaatcgggatgaaggaaccaaacctccattatgtgatccaagtgatgacccagacaaagtttggtatgttgatctgaagtcatgcattacaagactccctgaaaatggttatggagcaaatgtcacagcatggcctgcgcgtttgcaaactccccctgatcggcttcagagcatacaacttgatgcctatacatccagaaaggagctcttcaaagcagaatccagatataacgatgaattaattggaggttacgttcgtggtttaaaatggaagaagtttaaattaagaaacgtaatggacatgagagctggctttggaggatttgcagcggcactaattgaacatgatttgaattgctgggttatgaatgtggttcctgttagcggccccaacaccttacctgttatctatgaccgtggactcattggagtaatgcatgactggtgtgaaccatttgatacgtacccacggacctatgatttattgcatgcagccggtcttttctctattgagagaaaaagatgcgatatctctacaatcatgcttgagatggaccggatgctaagacctggtggtcgt

SEQ ID NO: 10021 - DNA, 696 bp, Malus x domestica
  Predicted polypeptide sequence is orthologous to G274
gcttacttcattgaaacagtgttcccccgaccaaaaagaaaaaaaagaactgaattgaaacagtgcgtgcaaacacacgggaagaacaacaaaagcatcctcggcctcatcgtaccttgtctttccagttaaacaacgaaagaagaacaacggcagagccgctcgccccgcctccgaaatcaaattcgtgtcagaattttagccgctgcccacgatttctgccgcatttcctctcataaagttgtcgtcttttttgttttgtcgtttgttttttcttggatgtctccgtctgtgtcgtgggttacggattgctggaggtgaaagatgcgtttgatttgatccgacccgaaaaagattcgtgcttttcgctccctgagatccgcacatcatggcgacaaaagggaactcaggagataacaggagtcgaagctccatgtcaattgtcattgtagctggcctgtgttgtttcttttacatattgggtgcgtggcagcgaagtggttttgggaagggagatagcatagctgtggagattaccagacagacagactgcagtatcctatccaatctgaattatgagacccatcgtggtgggattgacgattctgaaggagttgtcaaggagttcaaatcatgcggaaatcgctatattgattacactccctgccaagatcaaatgcgagcaatgactttccc

SEQ ID NO: 10022 - DNA, 2375 bp, Malus x domestica
  Predicted polypeptide sequence is orthologous to G274
cagattttaaagctttttgagatttttcagaggctttgcgacacgtctccaccgccattaccatctcagcactgaatcctccatcaccactctctctctctctctacatcataatatcatattctctccctcatcattcacacagaaaaaggagagaaagattttcccttttttctctgatacgtcggatagatctggaccctctgcttgctttttcctttaatgtaattggcgctaaatggctccgaaagcgaatgcagacggtcggactaggagctcggtgcaaatttttattgcagctggtctgtgctgttttttctatattttgggtgcttggcagagaagtggttttggaaagggagatagtatcgctttagcgatcactaagaatgaggctgactgcaatattattccaagtctaagttttgattcccaacatgccggtgaagttggaaatatcgatgaatctgaatcgaagcccaaagttttcgaaccgtgtcatcatcgttacactgattacaccccgtgccaagatcagaagcgtgcaatgacattcccaagggaagatatgaattatcgagagaggcattgccctcctgaggaagaaaagttacattgccttattccagcaccaaaggggtatgtaactccattcccctggccaaagagccgtgactatgtaccatatgccaatgcaccatataagagcttgactgttgagaaggctgttcagaactggatccaatatgagggtaacgtatttcgattccctggtgggggaacacagtttcctcaaggggcagataaatatattgatcagcttgctgctgtgataccaataaagaatgggacagtaagaactgcactggacaccggttgtggggttgccagttggggtgcatacttgttgagtagaaatgttcttgccatgtcgtttgcgccaagagattcccatgaggcacaagtccaatttgctcttgagaggggtgtacctgcagttattggtgttctgggtacaataaagctgccctatccatccagagcctttgacatggctcattgttctcgttgcttaattccatggggaataaatgatggaaaatatctcaaggaagttgaccgagttcttaggcctgggggttattgggtgctttcgggtcctccgatcaattggaagaataattaccaagcatggcagcgtcccaaggaggatcttcaggaggaacagagacagattgaagaagctgctaaacttctttgctgggagaagaagtctgagaagggtgaaactgccatttggcagaagagggtagactctgattcatgtggagacagacaagatgattcccgtgctaacttttgtaaagctgatgaagcagatagcgtctggtataagaaaatggagggatgcataactccataccctaaagtttccagtggggagttgaagccgtttccaaaaaggctttatgctgttccccccaggatttctagtgggtctgttcctggagtttctgttgaggactacgaggaggataacaacaaatggaagaagcacgtgaatgcttataaaagaatcaataaactaatagacacaggaaggtatcgcaacattatggatatgaatgctggtttgggtggttttgctgctgcaattgaatctccaaaattgtgggtcatgaatgtgatgcccacaatagccgagaaaaatacgctgggtgttgtatatgagcgaggattgattggaatctaccatgattggtgtgaaggtttctctacttacccaaggacatatgacctcattcatgcccatggtgttttcagtatgtacaatggaaaatgcaactgggaagacattcttctagagatggatcggatcttgcggccagaaggtgccgtcatattccgtgatgaagtcgatgtattaattaaggtgaagaagatagtaggaggaatgagatgggatactaaactggtggaccatgaggatggtccccttgtaccagagaaggtattggttgctgtgaagcagtactgggttggaaactccacctccgcacaatgaatgccttaaaaggactgcctcgaggcctcggcgtggatctaagctggcaatgttctctgttacaagtcctcacagggatgtgtatttttccagtgctcacttttgctgcccgagttcatacttcgtaaggaggagggcttacacaatctatgttcgttaactatcttccgccacgttcctttgtagtaattttcaagtaaacaaagctacagagctacaatgcttgtatgtttagggtgtcattcattttacaaaaccccttttttattattgaaattttaacgaaaaaaaaaaaaaaaaaaaaaaaaaa

SEQ ID NO: 10023 - DNA, 669 bp, Malus x domestica
  misc_feature (481)..(481): n is a, c, g, or t
  Predicted polypeptide sequence is orthologous to G2791
cttcaatgctggatgagataatcgattatgtaaaattcctccagctccaagtcaaggttctgagcatgagcaggttgggcggtgcagctgctgttgctccccttgttgctgatatgtcctctgagggtggcggtgactgtatccaagccagtgccaacggcgggacccgcggacggagctcaaacggcaaccaaacggcgtcatcatccaacgacaacagcatgacggtgacggaacaccaagtcgccaagctcatggaggaagacatgggctccgccatgcagtacctccagggaaaaggcctctgcctcatgccgatttccttggccaccgccatctccacagccacatgtcactccaggaaccccctcctccagaacagtaacaacaacccggtcatcccgtccaacggtggcgacgggccatcttcacccagcatgtccgtgctgaccgtccagtcagccaccatgggtaacggcgngggttgagggttccgtcaaagacgccacctccgtttccaagccctgactgagggcgccgccgtcgatcgtcgactgaccttttggctttggtctttacttttttagtgacaaatgaacacacacagtgacgtgggctacgaggcggtctaaagtctacgaaaataaggcaatctggggtggtgctttt

SEQ ID NO: 10024 - DNA, 619 bp, Malus x domestica
  misc_feature (534)..(534): n is a, c, g, or t
  Predicted polypeptide sequence is orthologous to G280
accttttaaatcctcaccttctttcctcatccgctctgcctgactgaacttcccaccaaacaaacagtctctctctctctagaaaacggtttcgctttctctctctagaaaacggttaacagtccccatctctcagtcagattctagtgaggaagctcccatggcgacggagaactccaacaatccactagtaccgccgccgccagttccctctctcccccagtacccagagatgattatggcggcaatcgaggccctgaacgacagcaacgggtcaagcaagtccgcaatcgcgaagcacatcgagtcaacgtacggagatctgccggaatctcacgtggccctcctcgcgcaccacctcaacaagatgaaggacaccggcgagctcgtcctggtcaagaacaactacatgaagcccgaccccaacgcgccgcccaagaggggccgcggccgtccgcccaaggccaagactccagtcccagctggcactgtctcctccccgcccaggccacgtggcaggccccccaagcccanggaccccttcgcaccgccacctcagcccaagacacattccggaactggaaagccacgtggccgccctcccaaaaaagccaaaacg

SEQ ID NO: 10025 - DNA, 771 bp, Malus x domestica
  Predicted polypeptide sequence is orthologous to G2802
gagggtacgccttgtccgccttccccaatgggactagcgaggccaatggttccgatgccccagctgcaaccgctaatattaacgtggcaaattcccttcttccagcgtcttccaccctggacatggcatccttcaagtctttaaactgccaaattccacggttgaactccggccacggagccatagggatgtacgccggcacaggagccgggccgaaatgcccggttggaacttcctaatcaagcttaattaggagggtcaacatgttttaagtataaccaaacaaaagccacccccgacaatctgtagataatcaaatgatatcaaatctctccaccagcaccaccagcaccaccaccaccatcaccgccagcagcagcagtaccaccatccaaatacccaacaatactacttactagttactaccatacaaaaatgcatacgtaaaaagggcagtgtaaggaaggaagtgggtccccgtcccatccccattaaccttttccttcttttatttgttgtttgtactattttcggtcacatctactccccccattttctgcactagctttatcaagtcggaagaaatcaaagcaccacaggttaaaagaaaaggagacacggtaaaaaaaaaaaatgttagtttgttgtaacttttggcactgtaattttaattttcacccttccaagtgaaacaattgcctaaaggtttagtgctagacgagtgttactgttagtctctgttatttcaagtgtaatcaaaatctttgtaca

SEQ ID NO: 10026 - DNA, 586 bp, Malus x domestica
  misc_feature (447)..(447): n is a, c, g, or t
  Predicted polypeptide sequence is orthologous to G2982
ccgttcattcttgtgcagactcgccctcatgcaactgttgaggtggaaatatcagaagatatgcagcttgtgcattttgacttcaatagcaccccatttgagctccatgatgacaactatgttttgaaggcaatgaagttttgtaataggcagcagggtgatgatgcgacacaaaatttaattgtagatggaggcgaaggttgtagcatgtcgggcatgtatcagccacaaatccctctttcttcaatgctaaacacagcaattagaccaccacccatgtcaccaccccttcccggaatactgaaagcacgcgtcaagcatgagcaccatggacaatagtgttagcatctgtatattgtggagagtagtttgccggaagtgaataggtcatcacgcaccctcatgattatcgttgttagatattgccataagttggatttagtttangtttcaaacaggcagatgagtcttggttggtttgatgctcgggaggatgttggccgcggcaaatgctttgctttgctttgcatgtccaatatgtgctattgtaatttttatcccattcttttttaattttaccgttttt

SEQ ID NO: 10027 - DNA, 396 bp, Malus x domestica
  Predicted polypeptide sequence is orthologous to G2983
ttttttttttttgattggaataaaagtgcttttggttccaaaaggcagaattagaagcagagctagctttcagtacaaattaagagacaattacttgcctttcttctttcccgaaacgaataagaaaagaagaaaaccaagaaaagaaggaaagcacatgacattgtcaaattaagcatatcccatcattttcttccttctggatgtaatgggaagagttccagagtcataactccaacactacctcccttaacggcgtcgtcgttgtcgaccttacatactacactaccatggtcaccctctaccaagcaatcaaatccccagctcctacactttctcttgtacggactatcttcctctctttccactactatttctcccagggtggtaattaca

SEQ ID NO: 10028 - DNA, 656 bp, Malus x domestica
  Predicted polypeptide sequence is orthologous to G2989, G2990
ctctctctctctctctctcgccaaaaaaacggaaccatctttatcactcctccatacctcccctcactttctcaacatcctcagagcttccatggcagctcagagctgtaatctgcacagaaatctaatcctaacgacttaaagcagctcccttttaactttctctgtatttgcttttgatttttgttctcattttttggagacccctagatgtttgagcgatggatataaccccgtccatcaccaccaccaccaacaacaccgccagtacaaaatccccggaagccgacagcgaaactccgactcggatccagcaacccttaaagcctctgtccttcagcaacggcgtcctcaagcgccacaaccccacgcaccacctccaccaccaaaacatccccatcacccctgtcgtagtcacctacaaagaatgcctcaagaaccacgccgctgcgctgggtggccacgccctcgacggctgcggcgagttcatgccgtctcccgctgccaacctcgccgaccccacctcactaaaatgcgctgcatgcggctgccaccgcaattttcaccgccgtgaccccgaggtaccccgtgcagccaaacacccccgccgcaacaacgcatgtcatcgagttaccaaccccaccaccggcaccatt

SEQ ID NO: 10029 - DNA, 669 bp, Malus x domestica
  Predicted polypeptide sequence is orthologous to G2989, G2990
accctattgaagttttcacctttgagatttcactccctaatatcaaaaccctaattaattcccaatccgcccgtcaatttcttatgcttcttctcgcctaaagatatggactttaccaccgtgaccgccaccatccaaaccccagatacggacaccgaaccgccgtcgccgacggaccccaaattcaacttcttcagtggcaggtccttatccttcaccagcggcgcattccagcctcagccgaagcgtacaagggtggttgcctacaaagaatgtctcaagaaccatgctgccagcttaggtggccacgctctcgacggttgcggcgagttcatgccttccccttcctccaacccagctgaccccacctcgctaaaatgcgccgcttgtggctgtcaccgcaacttccactgccgtgatcagtacagacccaaaaataatgttattcgcaaccgcctgctaccagcgccgaaaacagctcacaacaaccacagctcaagctccagcccgagctccagccccaaccctactttgagcccgcagtctccgccgccagtctcccacttgcccccctcctatttcgctgccccgccgcaaatgctactcgctctcagctccggcttttctggtccgcccgatgagcacccccaccagcaccagctcaatccg

SEQ ID NO: 10030 - DNA, 648 bp, Malus x domestica
  Predicted polypeptide sequence is orthologous to G2989, G2990
ccccatttaagttttcaactttgagctttcacaccctaagaacaaaaccctaatcagtttcttatgcttcttctcgcctaaagttatgaactttaccaccgtcaccgccaccatccaaaccccagatacggacaccgaaccgccctcgccgtcggaccccaaatccaacttcttcagcagcaggtccttatccttcaccaacggcgcgttccagcctcagtcgacgccaacaatggtggttgcctacaaagaatgtctcaagaaccatgctgccagcttaggcggccatgctctcgacggttgcggcgagttcatgccttccccctcctccaacccagctgacccgacctcgctaaaatgcgccgcttgtggctgtcaccgcaacttccaccgccgtgaccagtacagacccaaaagtaatgttattcgcaacccccaccgcctgctaccggcgccgaaaccagctcactacaaccacagctcaagccccagcccgagctcgagccccaacccaactttgagcccgcagtctccaccgccagtctcccacttgcccccctcctatttcgcttccccgccgcaaatgctgctcgctctcagttccggcttctctgggccgtctgatgagcacccccaccagcacaactc

SEQ ID NO: 10031 - DNA, 621 bp, Malus x domestica
  Predicted polypeptide sequence is orthologous to G2989, G2990
gattgcaaaagagcgaagaaagactggtggaggatttctgcagcgaggtggggattgggaggggagttttcaaggtttggatgcacaataacaagcacggtcggaggagattggagagattgggcagcggaaacggcagcttaggcgacggtgggaatatgaacaaaaatgtcagtgagatcaacggtgatggtgaaagacttggttttgactccatgaatgctcacatcgccagctacaatgtcaatgccaaccccctgaacgaaggcagcagagcaagtttccacctttccaccaatgggtcgtcgtcttcgtcgtgaaccagagagaaagatggaagcttttgggagatattaaagttaattaatcacgcttattagtataaacatctcttgttaattcgctagctcgttcgttaattaatagctaccgcgtactgaccgatctgctactgttttggcgaggccgagaggaagggattagagaggataacgattaaagagaaagttaatcatatgtttagctgaaagatattattcttaatgcaaagttaattagtcgatgtttttagctttccattagtaatataaagttgctttcttatgcaaaaaaaaaaaaaaa

SEQ ID NO: 10032 - DNA, 735 bp, Malus x domestica
  misc_feature (621)..(621): n is a, c, g, or t
  Predicted polypeptide sequence is orthologous to G2998, G2999
ggagatcatgatccaaacacaaacgaagtatacagagagtgcttgagaaaccatgcagccagcctcggcagctacgccacagatggctgtggcgagttcacacttgaccacgcatccccaggcggcctacaatgcgtcgcctgcggatgccaccgcaacttccaccgcagagtcacttacgcagccacgtcatcgcaagctgcaggaggcggtagatcaggacatcagcaacaccatgtcatcatgagctgcagtagccgaggtcgagatcccgccgaaaatatcataacacaagaccaactcattgactacaatgccggtggaggtgggtcgccggacagcggagagaggatgagcagcgggaagaagcggttcaggacgaagttcacggcggagcagaaggagaagatgctggcgtttgctgagaagttagggtggaagctgctgagaaaagatctagaggacgagatagagaggttctgcaagagtgtaggggtaagcagacaggtgttcaaagtgtggatgcataatcacaaaaacctttcatcttcttctacttctgcatccaccggcaatgcatcttctctcactacccagtagtaccacctctctactctctangcactaattaatcctcttaatccatcgctttagctttagccttttattttctttcctttttattatttggacgtgtttggtcctcatcatttagtccttttttattttcttttt

SEQ ID NO: 10033 - DNA, 696 bp, Malus x domestica
  misc_feature (618)..(618): n is a, c, g, or t
  Predicted polypeptide sequence is orthologous to G3055
aattgtacttccaaattcaaatggattatggtagagagagcaatgcggtccaggtagtcactgggaatagtggtggtgatatttggtctggtgaccaagcggtttgggctactgaggatgagtaccgagtttggaataatggtgacgcgatggcggacaccatgtccaactcaagttatgatcaaaggcaatcgcaaagtcactctggaagcgaacctccaaataagaaatcaaggaactcccaagatgcaacttcatctaaccggtcgaaagccattgggaaaatgttcttcaaaaccaaactttgttgcaaattccgtgctgggacgtgcccctatgtcaccaattgtaactttgctcatagcattgaggagcttcggagaccgccaccaaattggcaagatattgtggctgcccatgaggaagaaaaggctgtatcttcagagccaagggaagagtatcaaattccaatcgtctctacaggttatggtgtggagactccacgatcctataaagggaggcattgcaagaagttttatactgaggaaggttgtccttatggggataattgcacttttcttcatgatgagcagtcaaagaatcgagagagtgtggcantaagtttaggtcctggaggatatggcggtgctgctgctgctgtgaatggagcaaataacaagccatcaaactggaaaa

SEQ ID NO: 10034 - DNA, 422 bp, Malus x domestica
  Predicted polypeptide sequence is orthologous to G3060
tcaaatcccaatctcaggaacattgaactggaggggacctttgaacagattcagcaagctagtgccatggtcagcgagctaattgcgactgtttcaatctccggccctggtaaggctccaggaggaggaggaggaggcccaggagccccagcccctccaggaagtaactataagacgaaactatgtgataattttaccaaggggacttgcacctttggagaaagatgtcactttgcacacggggctgctgaattgcggaagtctggagtgtgagtgctctttgaaattctttttcttgcagtcaggatcttatactagtgggagagctgttttgatttgtcgatgtgcgatgctacctagaggaattaacaagattatgatatcatagtttttgtgagcaaaaaaaaaaaaaaaaaatcgtg

SEQ ID NO: 10035 - DNA, 642 bp, Malus x domestica
  Predicted polypeptide sequence is orthologous to G3067
cgcccttttttttttttaactaatgaatgattttcacccaaaagcacatttttttatatgcttcaactttccaaacaccaactgaagacaacagatttactgagctattttttcctcctcctccaaaagcaaaaaagatgaaaagaatcttcagggtttgcagatgaccagaaagcagggaaggagagctctaggatttagcagataaagctcttcaatgttagaataaagccccatttttccagccaatgaatcgaaccccgtttgcccagtaatttcctgaatattttccaatggcttatgcactctcccagcaatcactctgcacactatcaaagccttccttagagttgcatcttcctccaatatttgaattgcttcaaaagctcttccacttgtagatgttgtaaaaacaccaacaccttccttgagctcctttttcgcagagaacccgttacgtatgatcctacaaacgctgcatttctccaatacgcaaaggctcgaggagccatttaggccgagacagcaggccacggtggtgccataaaaccccaaaagctcattcccatccgcactgcccctagggtggcctcttgggcagcttgctggcttttggactctccccctcacaacacctttaaa

SEQ ID NO: 10036 - DNA, 543 bp, Malus x domestica
  Predicted polypeptide sequence is orthologous to G3067
aaacttgaagaaaaaagtggaaaggtttgaaaagtgctgttggaggaaggagaaaaaggggtattatcaaattaatcaaaaaatgccaacagtgtggttttctctgaagaaatctcttcactgcaaatcagagccatcagatgttcatgatccaaggggcaggaagcaactgagcacaatctcgactagaaaagcaggaggaggaagatcagggtgctcaagatccatagcaaatctcaaggatgtgattcacggaagcaagaggcatatggaaaggccaccaagtaattgcagcccaagatccattggaagcagtgagtttctcaacccaataacacatgaagtaattttgagcaactcaaggtgtgagctgaaaatcaccaccaaccttggtggcttccaggacggagttgggggtggaaatgccaacaatggcagcggtggtggcagtgtcggtggtggttcaacttttgttgataccctaaagccaggcacacctggtcctggtgggcaccctacaatgcactacttcaatccatcttt

SEQ ID NO: 10037 - DNA, 578 bp, Malus x domestica
  Predicted polypeptide sequence is orthologous to G3074
ggctggacctatctccgagcctaaacatgaagaatatcctgggtggtctctctctgatgtggatggaatggccattgatcctgttcaacttgcaaatctcagcagaaggctagacgaggatgacgaagattatgacgaagagggctaaattcctctcgatggcttattgtcccaaagtagggtagcgggatcaagatcagtggaaagctcttgaaggaaaactaaataaaagtatacaaaagctggaatagcgacctaaatggagatgaaatggcccgtgcactttgtcccaacgaagagtccgaatttctcttcctgtccaatgttagtatcgtagcatttcctaacatccatttccagaggtagcatttccgtgacgatggcagagaggatagcctctgcaaattgactcttagcagtgtatgaagaatatggcacccttgaatagcggtggattgccctatgagtggtttgcctttttaatttactgtgtttgttatagattttcaggacaagtagtagcttgctcgtcgttatcgcgtggaaggtaatagttctgttagccctttcaaaaaaaa

SEQ ID NO: 10038 - DNA, 622 bp, Malus x domestica
  Predicted polypeptide sequence is orthologous to G3074
cgttgctgtcgcttcagcagaccattatacctaatccaaaccctggaatggtggcggatgatgtttccgagtcgaaggatgtattgagggaaaatgtcactgtccctgatgaaactgatccagcagttcgaaattttgatctgaatgctgatgtaaatgataacgaggacacaaaagctgcagcaagagcagcccaagctggagcaatggcatcccaagcagccccagtggcatcccaagcagccccaatggcagcccaagctggagcaatggcatcccaagcagccccagaggcatcccaagcagccccaatggcagcccaagcctcatcagccggacctatttccgagcctaaacatgaagaatatcctgggtggtctctcgctgatgtggatagaatggccattgatcctcttcaacttgcaaatctgagcagaaggctagacgaggatgaagaagattatgacgaagagggctgaattccacttgatggcttattgtcccaaagcagggtagcgggaacaggatcagtggaaagctcttgaaggaaaattaaataaaagtaatacaaaaggtggaatagtgacctaattggagatgaaatggccagtgcactttgtcc

SEQ ID NO: 10039 - DNA, 616 bp, Malus x domestica
  Predicted polypeptide sequence is orthologous to G309
gctcgcccaattggctgaaaccatccacgtcgagtttgaatacagaggatttgtggcaaacagcttggccgatcttgacgcgtcgatgcttgaactcggaccgagtgaggttgagtcggtggcggtcaactcggtcttcgagttgcacaagctgctggcccgacccggcgcgattgagaaggtgttatcagtggtgaagcaaatgaagccggagattgtgaccgtggtggagcaggaggcgaaccacaacggtccagtgttcatggaccggttcaacgagtcgctccactattactcgaccctgtttgactcgctggagggatcggcgaacagtcgggataaggtgatgtcggaagtgtacttggggaagcaaatctgcaacgtggtggcgtgcgaaggggtggaccgggtcgagaggcacgagacgttggcccagtggcgagcccggttcggctcggcagatttcgtcccggttcatctcggttcgaacgcgttcaagcaagcgagtatgctgctggcgttgttcgccggcggagatgggtaccgggtggaggagaacgacgggtgtatgatgttggcctggcacactcgcccgctcatcgccatctcggcttgg

SEQ ID NO: 10040 - DNA, 657 bp, Malus x domestica
  Predicted polypeptide sequence is orthologous to G309
cgtacttcgctgaagctctggctcgtcggatttaccgaatataccctcatgattgcctcgattcttcctactcggacattctccagatgcacttctacgagacctgcccctacctgaaatttgctcacttcactgccaaccaggcaatactcgaggcttttgccacggcgaccagagtacacgtcatcgatttcgggcttaaacaggggatgcaatggccagcgctcatgcaggcgctggcactaaggcccggtggcccacccgtgtttcgcctgacgggtattgggccgccgcagcccgataacaccgacgttctgcagcaggtgggatggaagttggctcaattggcagaaactattggggtcgagtttgaatttcgaggattcgtggccaatagcctggctgacctcgagccgtctatgcttgacatccgtcaggacgaggccgtagcggtgaattcggttttcaagcttcacggtctcttggctcgagccggggcggtggacaaagtgttgtcatcaatcaaggccatgaagcctaaaattgtgactattgtggagcaggaggcgaaccataacgggccggttttcttggaccggttcacggaggcattgcattattattcaagcttgttttgactctctggagggatcgtcc

SEQ ID NO: 10041 - DNA, 643 bp, Malus x domestica
  misc_feature (590)..(590): n is a, c, g, or t
  Predicted polypeptide sequence is orthologous to G3111
atgtttttcaccggaaaaatccccttcttactccgttcttttgcatcttaacctttatcattgtcctgatcactccactcttgagcatcttaatcgttgttgttgtcatgatcgtccgcctggtgctgtggcttgctgcattgttcgaccgtcacatggccagatctagcgcttccacgcctcagcctcccaaccctttgcctgaccaaggactcgaggaaatgattatctgttcgcttcctagcgtctcgtacaatgcagaagcggatgcaagactagcagaatgtgcaatctgcttgatggagtttgtggatggagatgtcacaagggtgttgcctcattgtggtcacggattccatgtgagttgtgttgataggtggctgaggtgccactcttcgtgcccgtcttgtcgcggcagtgtggttgcggaagaggggtgttacaaatgaagttggtatcgagctcatggattcggagtttggagctctgataagagggagaggaaaatatagaaaaacagatcatgtaattggcctgaatcattaacagtttgattcaagccgctgcaattttcattcaattcgaagcanatgtaaaatttcgacatgtaaattagtaaagcaatcacctttcccaaaaaaaa

SEQ ID NO: 10042 - DNA, 810 bp, Malus x domestica
  misc_feature (606)..(606): n is a, c, g, or t
  Predicted polypeptide sequence is orthologous to G3111
attgaatatttccacctctggtttctgaaaacgacattagattatagatataccgccgtatgatcagccatgcctcgctctcaaagatttctaggcagcagcaccccctccgccaacttctcaaacataacagcagctccgcctcctgaggccgtggttctcgagtcggacttcgtcgtcatactggcagcgctgctctgcgccgtcatatgcgtggtgggtctactcgccgtcgcacgctgcgcctggctccgccgcggatccgagggcagagccgctatcggatcggcttcttcatccgccaacaagggcctcaagaagaaggtcctccagtcccttccgaagttcacgtacggaaccggcggcgccgagcccccgccgaagctgggttcggagtgcgccatctgcttaggggagttcgcggaggggcacgagatcagggttctgccgcagtgcgggcacgtgttccatgtcgggtgcattgacacgtggcttggatcccactcctcgtgcccgtcgtgccggcagatcttggtggtggctcggtgtcacaagtgcggtgggtttccggctccaatatcagaggcggagctcaaggctcacccngaccacaccaaccattcagctccctcctccggcagcggcggctgcaactgcccccagtactgccattagtaatcatttccttctaataccgctacaactacccatttttccggccttaaaagtttgctaactaaccaaaaccccctttttttaaaattttttccttaaattttaaccaagcccccttttttattttttttcttt

SEQ ID NO: 10043 - DNA, 609 bp, Malus x domestica
  Predicted polypeptide sequence is orthologous to G326
tggtgagaatttggtgccaggtacgccggcaaggaatggttggcaggaggagaatgggagtgagaatatggaagggcatgcttcaattgatgtgaggaatgagaatggaggtgttgacggggttgtagctccagctgcggcttcgcagccagtgttgcagcagcaaacaccctttacgactctgctcatgatgccggaagagaaccgtgacggtgacatgttgtgggatagcaatccccatggacacaacactcagatatgggattttaatttaggacggttgagggatcatgaagagtcaggtccattggaagtcacatatggttcaaacgattcaggatttatgattaagaattttagcgaacttgtgaaagaaacatcattgactgatacaaaaatgttcagagatatgtaccaggtgaactgccctattggacatgaggacataaaattcaatttgaattttgacggccatcatcagggaccagcaacatctgcaagcagcaacgtccctattggacggccatcatcagggtcggtatttggcgaagacaaatgttgtggttcctctaccgacatcaattttatggaacaatcatttgttatgaa

SEQ ID NO: 10044 - DNA, 617 bp, Malus x domestica
  Predicted polypeptide sequence is orthologous to G328
atagtgttgtgccagttcatcagtatggagaagtagcgaaagcccaccagatgcagcagctgcagaagcaaagttttcatcagttgggtttggagtatgagtcctcaaaagctgcatacagttacaatggctctctaagtcacagtgtttctgtttcatccatggatgttggagttgtaccgaattcaacaatgagcgatatctcaatttcacacccgagaactcccacaggaactgttgaccttttcagtggatcttccattcaaatgccaacccaactaagtccaatggacagggaggccagggttctcaggtacagagagaagaaaaagacgaggaagtttgagaaaacaatccggtatgcctcaaggaaggcctacgccgagaccagaccccgaatcaagggccgatttgcaaagcgaactgaaatggaagttgaagtcgaccaaatgttctccacaacgctgatggcggaaaatggatatggcattgttccatcattctagttacgacattcaaaagatgaaagatgaccctatctcttcaaataacacttgtgctggtttttaatcatattactttaagtctgctactgatatttagtgtatctttttccc

SEQ ID NO: 10045 - DNA, 692 bp, Malus x domestica
  misc_feature (120)..(120): n is a, c, g, or t
  Predicted polypeptide sequence is orthologous to G351
atcctctctctgtctctctctctctctctctctctgtcaaaacaaaaaacagaatttctcaaattttcatcagcaagcatcagatggctctgcaagctctcaactcgccaacacacgccnggatcgtctcctttccagctcgagaccaaggcctcgagcttcagctatgtcgagccgtggaccaaacgcaagcgttccaagcgtccacgcctcgacacccctcataccgaggaggagtacctcgctctctgcctcatcatgctcgcccgcggtaatagagatggagacctcgccgctaccacagccactaaagcaacagcctccgctgcctcacaccagatcatcactcaatccccttctatggagctctccacgtcaacagcgccgccggctaacctgagctacaagtgctctgtttgcgacaagagcttctcttcttaccaggccctcggaggacacaaggccagccaccgaaaaggctctgctgccggatcggccgtcgaaggcccgtccacgtcctcaaccaccacaacctccgccaccaccaccgccatcccttcgggaaggtcccacgagtgctccatatgccacaagtctttccccaccggtcaagccttgggcggccacaagcgctgccactacgatggcggcgccgcaggatccaccgctaccacaagcgctataacttcctc

SEQ ID NO: 10046 - DNA, 519 bp, Malus x domestica
  misc_feature (460)..(460): n is a, c, g, or t
  Predicted polypeptide sequence is orthologous to G351
ccgattttttttttttttttttgaatattccaattacttcaacagcatgtttatacaagaacaaaataatccaaacccgtaaaacaaatcaaagaaataactgaaattacacgccggatattaattccaatatttaattcctaatttaatgtctacagaagctgattcgcagagtcgaccggaatcgtcgtcctaattttgttggtcctgtgaagtctcggttttgggcttcatcatcagtagaagcctgggcttcttcgtcgggtgggggctctccacttcgtcctcgccggagatgaagaagtcgcgggagaactcgggcaacgccggcaggttcaggtcaaacgtctctcgggggtgaccgtggctgaccgcgtgagaagttgacccaactccctcagaggaagttatagcgctcgtggtagcggtggtggtggctgtggatccggcggcgccgccntcgtagtggcagcgcttgtggccgcccaaggcttgaccggtggggaaagacttgtggca

SEQ ID NO: 10047 - DNA, 600 bp, Malus x domestica
  Predicted polypeptide sequence is orthologous to G351
caattctctcagctctctctcctcccattctctctctaaaaacagaaaacagaacctcttaaaagtttttatcaaccatcatcagatggctctgcaagctctcaactcgccaacagccgccggagcctctcctttcccatttgagaacgaggcctccagcctcggctatgccgagccgtggaccaaacgcaagcgttccaagcgtccacgcctcgacacccctcactccgaggaggagtatcttgccatctgcctcatcatgcttgcccgcggaaacagaggtggagacctcgcctctactaccgccaccgctgccacagccactaaagaaacaaactccgccgcctcacaccagatcatcactcaatccccttctatggagccctccacgtcagcatctccgccggttaagctgagctacaagtgctctgtttgtgacaagggcttctcttcctaccaggcgctcggaggacacaaggccagccaccggaaaggctctgcagccggatcggccatcgaaggcccgtccacgtcatcaaccacaacaacctctgccgcggccaccgccaccgcttccggtaggtcccacgaatgctccat

SEQ ID NO: 10048 - DNA, 691 bp, Malus x domestica
  Predicted polypeptide sequence is orthologous to G363
cacgaggcatgagccaagtaacttcgaacatacctctgcaagaagaatcccctgacgcctctaaggacagcacaaccacttcttcatgcctcacaaatcagacaaaccatcaacaacaagatcccgggcctgttgcacttgacttgacactccagttttgctccagcgacattgaattgaagggcacaggggagactagcagtgaaggagctgcaccccctacttcagaaggaacaaacccaagggtattctcatgcaactactgtaagcgtaagttctatagctcacaggcactcggtggccatcagaatgctcacaagagggagaggacaatggccaagcgtgctatgcgtatgggaatgtttcccgacaggtatactagcttggcatctctccccctacatggttcagccgcttctgcattccggtctcttggtatccaagctcattctgcagtgcaccaaaacacaatggtatcatcagatcatccgaggttccctgtccccgacacaagaggcgtagcgaggtttcaacagggctattttggagtgccggtgttcatggacgaggatgacgagggcatgttttggcccgggagtttccggcaggtaggcaaggagggagttggaggtcattacaatgtgcaatctgcccaaaatccaaatatgaattcagggacaagctcggcacc

SEQ ID NO: 10049 - DNA, 647 bp, Malus x domestica
  Predicted polypeptide sequence is orthologous to G363
cacgaggatttttaagtgaactgtttgttctcagtctttcatgatctcacccaccactttgttttatcagaaagcctgttctttgttttgagatgttcaactgcaattctatgacaagaaacactcaactggcagatgtctgctaattcaagcattgcaatactatggaatccaggagctagccaattgtacttggtcttcaaccagatctatggatgtataagatcagctagcccttactggaccagctcaatccggttatttcaagtctgatatgtaaactatcccccccacctcaacgacagccaatcatgaacacatatattgaccttgaagtggaagcctcatcggcaaatgactctgatgttagcagccaagttgcttctaacatctccatccaagatacatctgctaatacctccaaagacagcgcggctaactctttccatttttcatacctcaatgcagctcagcaaggattgggtcctgcagtttcccttgatttgacacatagcttcaataaggaggacttagggagaagggattcgacaggactctcattgtcgagcacgagtgagagcagcaatgaaccttcatctcagaacatagcatcagccagtccaagacttttttcttgcaattactgt

SEQ ID NO: 10050 - DNA, 2423 bp, Malus x domestica
  Predicted polypeptide sequence is orthologous to G385
ccaaataaaaacccaactggaaccccatgaaaactctttgctgaggcaagagaacaataagctccgagcggagaacatgtcgattcgtgaggctatgaggaacccaatttgctcaaactgtggcggtccggcaattattggagatatatcactagaagagcagcacctcaggatcgaaaatgctcgattgaaggatgatttggaccgagtttgtgcactcgccggaaagtttctaggccgacccatctcatccctgggtgcatccatggggcctccgctcccgagctccactttggagctcggagttgggagcaatgggtttggtgggatgagcaatgtggctacatcgatgtccatgggaaatgattttggaggtgggattgggagtgctatgtcagttgtgtctcatggcaggcctagtgtgacggggctagaccggtcgatggaaagatcaatctttctagagcttgctttggctgccatggatgaattggttaagatggctcagacggatgagcccctttggcttaggagcttagaaggtggaagggaggttttgaaccatgaggaatacatgagaaatttcactccttgcattggattgaaaccgaatggtttcgtctccgaggcttctagggagtctggaacggtcatcatcaacagcttaactcttgttgaaactttgatggattcgaatcgatggttggagatgtttcctggtgtgcttgcaagaacctcaaccactgatgtgatttccagtggcatgggaggaactagaaatggtgcacttcaactgatgcacgctgaactgcaagtcctatcgcctttggttccggttcgtgaggtcaatttcctccgtttctgcaagcaacacgcagagggcgtgtgggctgtggttgacgtgtcagttgacgccatccgtgacaccaccggggtaccgacatttatgaactgtaggacgcttccttctggctgtgttgtgcaagacatgcccaatgggtactctaaggttacttgggttgagcatgcagagtacgatgagagccaagtccaccacctataccgacccttgttaagttccggcatgggcttcggcgcccaacggtgggtctccacccttcaacgccaatccgagtgccaggccattctcatgtcctcctgcgtcacctcccgcgaccacactgccatcactgccagcggaaggaggagcatgctgaagctggcgcagcggatgacggacaacttctgtgccggggtatgcgcatcgacggtgcacaaatggaccaagctgaacgccgggaatgtcgacgaggacgtcagggtcatgactcgggagagcctataccaccctggagagccgcccggtgtcgtgctcagcgctgccacttcggtctggctgccattctccccacagaggctatttgatttcttgcgcgatgagcgactaaggagcgagtgggacatactctccaacggtgggcctatgcaggagatggcccacatcgccaagggccaggaccccggcaactgcgtctccctcctgcgcgccagagcaaacgcaaaccaaggtagcatgctgatcctacaggagacatgcatagacgcggcagggtcgcttgttgtgtacgcgcctgttgacattccggccatgcacgtggttatgaacggcggggactccgcctatgtggcgctcctgccatccgggttcgcaatcgtacctgatggcccaggctcgcgcgggcccatgtttggcaaaggcggcagtcacggcagcggcaacagtggcggtggcgttgacgacggtggccatagagtgagcgggtccctcctgacgatgacgtttcagatcctggtgaacagcctgccgacagcgaagctgaccgtggagtcggtggagacggtgaaccacctcatatcgtgtaccgtccagaagatcaaggccgccctccattgtgagagctgatcatccatccgatcatatatcctgtgtggggtcacgtgatctaacctcaccttgtagcttttgtgtttttgttaggagacttttattaatgtggttgtgcatgtggcggcggtggcggtgtaagttatattaggcggcggtgcatgatgagtgaatctggtgggggtattgagtcaagaacgaaccgcactggagagtccttgcatggtgataaggatacatgaaacttgcacgcacgtgtgatgacttgcacacgtgtttggggagtgcgttcttagcacaatgcaaggctggtggttcgggtattgactcgggtccacccctgttttaaatccagaaaatgagtctggctcaacatggattgtgaaaagcaaaaaattgttggggaaattgaacctttttggagttttatattttagttaaaagttttgtgaatttaaaaaaaaaaaaaaaaaaaaaa

SEQ ID NO: 10051 - DNA, 582 bp, Malus x domestica
  Predicted polypeptide sequence is orthologous to G4
gacgaggacgatgaaatggttgatttcaagccctctgctttctctgccggaaacccctcttttgctcgtggttctaccgctgtgaaatctgtggagtttgatgggcaagctgagaaatctgcaaagataaaaaggaagaaccagtacaggggaattcaccagcgcccatggggtaagtgggctgcagagatccgagacccaaggaaaggggttcgggtttggcttggaacattcaacactgcacaagaagctgcaagggcgtatgatgccgaggcacgtagaattcgcggcaagaaagcgaaggttaatttccctgaacaaactccttgtgcttctgcaaagcgttccatcaaggaaaatcctcacaaattgatagccaagacaaacttgaatggcactcactctaatctgaaccacaatttcaattttgtgaacgactcaagtgaggactactacagtgctctgggttttctggatgaccacccccccctgaataactttccatacctgtcccccttccctgccaatgaagatgttgcacctgactcctctgtctcatcaccacatgcccctctttttttc

SEQ ID NO: 10052 - DNA, 682 bp, Malus x domestica
  Predicted polypeptide sequence is orthologous to G4
acccaacaaagaagatgaagcctaactcacaggatctggagcctcctgaggataattcgggaaagacactgtctgatgagctctcagcttttgagatgaagtactttcagaccccatatctcgatgagagctgggatgcttcagtggacgcgttcctcaacggtgacgcaactcaggatggtggtaatccaatggacctttggagctttgatgatctgcccgcaattgttgggggagttttttaagcgatgaacctttccccacctttctagtttatgtaaataaagctacatgttagtgagtttttcagtcctctgtgagcttctacattgtttcattattggtctcgtgttcgctcccattttctccagaaagagttgtcggtttcctttacttgtgcttgcaggatgtgtttcgggttggagtgcaactgtgtaggctgttgaacatgcataaggcctgtgcggggagtattttaagccgtagctaatgtcatatggagagcgtataggtattaggtttactttcacctccaaagagcttgaacttgtggtttctcaactttgatgtttgtattgatgaaattgtgtgagctatgatggaatactgaaacctcataaatctgtacttgtttaaatttattcaggtcttttcttttacaaaaaaaaaaaaaaaaatgcgt

SEQ ID NO: 10053 - DNA, 748 bp, Malus x domestica
  Predicted polypeptide sequence is orthologous to G4
gaattccgttgctgtcgaccagtacaggggaattcgccagcgcccatggggaaagtgggctgcagagatccgcgacccaaggaaaggggttcgggtttggcttggaactttcaacactgcagaagaagctgcaagggcatatgatgccgaggcacgcagaattcgtggtaagaaagccaaggttaacttccctgaagaaacccctcgtgcttctgcaaagcgttctgtgaaggcaaattctcagaaactgatacccaagacaaacgtgaatggcactgagtctaatctgaaccagaatttcaattttgtgaacgactcaagtcaggactattacagtgctctgggttttctggatgaaaagccaacattgaataactttgggtatatgtctaccttccttgccaatggagatgttgcactgaaatcctctactccatccgatcctgcccccttttatttgagttccgatcagggaagcaactcatttgattgttctgacttcggctggggagaacaaggctcaaagactccagaaatctcatcagttctttcttctgtgatggaagaaactgatgactcactgtttctcgaggatgctaacccaacgaagaagctgaagcccaactcacaggatctggtgcttcctcaggataatgcaggaaagacactgtctgatgagctctcagcttttgagatgaagtactttcagaccccatatcttgatggggagctggggatgctttcagtg

SEQ ID NO: 10054 - DNA, 643 bp, Malus x domestica
  Predicted polypeptide sequence is orthologous to G409
cacaagttcccagccatagaaaaagcaaaaccttgcagttgcagaacgctttcttcctctgcaagaaaaaacctcatgatttcaccatttttctcactcatcccaagctcttagtaactttcacagcttctcgtgagtgatgggcgtgatctcctctttctctcatactttccacattacagtgattctgacattaaacccaccacttttaagcccctgataatccgattaattacccacacagcatttaaattttgtgaactgattacgtttaacatatatgacgagtgggaaactctacggttcttctgcggacatgaaagtaatttttcaaaacgaaaagcgacctcgctcttctgacgttctcgagtctctctggattcccactccttcctcttcttttcatggttcaaattcaatggttaattttgaaaatgtaagtgaaggggactccttggataggcctttcttccaacccaaacaagaaaacgaggatgaggattattacggtggctaccttcatcaacccggaaagaaaaggcggctcacggcgaatcaagttcagtttctggagaagaaattcgagttagaaaacaagcttgaacctgagaggaaggtgcaacttgctaacgaacttggcttg

SEQ ID NO: 10055 - DNA, 710 bp, Malus x domestica
  Predicted polypeptide sequence is orthologous to G409
atcagatggtacatatgctggagaagagctttgagacagagaacaagctggagccggagcgaaagacgcagctggccaagaagctaggcctgcagccgagacaggtggccgtctggttccagaaccgccgcgctcggtggaagaccaagcagctcgagcgggactacgaccttctcaaatcttcttatgacacccttttgtctaattacgactccatcctcaaggagaatcagaaactcaaatcccaggtggtttccataaacgagaagcttggaggtaaagaggaggctaatagcacaaaagcagcaacatttgcaggggctgaccacgatgacgagaagcgtggccctcttcttccagcgggcgatcagatgacggaggttgttccaataactagtctccagcacagttgcaccatcaaggcggaggaccgcctgagctcagggagcggaggaagtgccgtggtggacgaggccgaaggcgctcagcctgtggacagcggtgactcctataatttcccaaacaacatccataacgactaccctcatgatcatgatacccatcatcatcatcatcaatatgtggcgccacatgatcatgtagaacatcatcacagcggagtccactcagaagaagatgatggtagcgatgacggccagggttacttctccgatgtctttgcagtcgcagcggcggagcagcaagcagca

SEQ ID NO: 10056 - DNA, 566 bp, Malus x domestica
  Predicted polypeptide sequence is orthologous to G409
tgaggagttgcaagccaactacaataatctcaaggctaattgtgaaagcctttccaaagagaacgataaactaaaggccgaggttactgtcctctcagacaagctgcatctcaaagagaaagagaggggaaattcagaactatctgataccaacagattatctcaagaaccgccgcagaagccaattgctgacacggtctctgaaggcgaagtatctaaagtctcagctgtggcctctaagcaggaagatcttagttcaggcaggagtgatatatttgattcagacagctcacactacacggatggagttcactcttcactcttggagcctggtgattcttcgtatgctttcgaacctgaacaatctgacctttcccaagatgaagaagataactttaccaaaagcatgctgcctccatacatcttcccaaagattgaagatgttgattactccgatacacctgcgaattcatgtaattacgcattcccggtggaagatcatgccttttggtcctggtcttactaagtttctaatggcaaatccgaatccccggggtattatcatc

SEQ ID NO: 10057 - DNA, 691 bp, Malus x domestica
  Predicted polypeptide sequence is orthologous to G409
ttgtagcagcagaacaaaaacaactctttcttcttctgcaaaacaaccccatgattttaccattttcctctctcaccccaagctctttactctcacaagagtgatggatgtgagctccactttctctcacactttccacattgcagtaatcctcacattaaacccaccacccttaagcccctgataattcgattaattacacacacatcatttgatttttgtaaactgattgcattaatatatggcgagtgggaaactctacggttcttcttcttcttcttctgcggacatgaaagtaacttttcgaaacgaaaagcgtcctcgctcttctgacgttctcgagtctctctggattcccaatccttcctcttcttttcatgcctcaaattcaatggttaattttggaaatgtaagtggaggggattcattggataggccattcttccaacctaaagaagaaaatgaggatgaggattatgacggtagctaccttcatcagcccggaaagaaaaggcggctcacggcgaatcaagttcagtttctggagaagaattttgagtcagaaaacaagcttgaaccggagaggaaggtgcaacttgctaaagaacttggcttgcagcctcgccaggtagcaatctggtttcaaaaccggcgggcgcggtatagaacaacagttggaaaaggatatgat

SEQ ID NO: 10058 - DNA, 723 bp, Malus x domestica
  Predicted polypeptide sequence is orthologous to G409
tgtgtgcagccgctgttcccacacttcccacatcacagaaatcatcatcaccagcttcttccgccacaaagcgtgattctttccaacccagagcttcggatcactctacttctcaaacaccaagctgtgatgttctcgacagcaacttaacaaacgcctagtatacaaaactaattcgtcggagtgttgactgtgaacatggccggcgggagggtcaacggcggccgaaattcgtccgtcctcagtgctttgcttcagaaccagaggagttctgagcctcttgattctctgttcctttctgggtcatcaaattcttcctctgcttcttttctgggttcaagatcgatggtgagtttcgaagatgtacgcggaggaagtggattgaataggtcattgttccaccagtatgagcacgaagataacggggaagatgacttgggtgagtatctccatcaacctgggaagaagaggcggctaaccgctgatcaagtccagtttctcgaaaaaagctttgatgtggaaaacaagctggaaccagagaggaaagtcctgcttgcaaaggaccttggcttgcagcctcggcaggttgcgatatggttccagaaccgccgggcgaggtggaagacaaaacaccttgagaaggattatgaggtgctgcaagccaactacaataatctcaaagctaaatgtgaaagcctttcaaaaaaaaatgataaaactgaa

SEQ ID NO: 10059 - DNA, 580 bp, Malus x domestica
  misc_feature (506)..(506): n is a, c, g, or t
  Predicted polypeptide sequence is orthologous to G428
aggcacaagactctccgcggacaaaggaagatcatgagctcaaggataaactgttgcgtaaatacagtggctatattagcacccttaaacatgagttttccaagacgaagaagaaaggaaagctaccaaaagaagcaaggcaaattctctttgattggtggaaccttcactataaatggccttacccaacggaagctgattaattatctggtatggtgcaggaagctgataaaattagtcttgcccaagtgactggactggatcagaaacaaattaataactggtttataaatcaaaggaagcgccattggaagccatcagagaacatgcagtttgctgttatggacaggctttatggaccatgttttaccaaggattgatccggcaatttaccatcctgtttttactctttgtacatgattaataattaactcaatttggttatgttcctcgtttactaatgttcgttttgttattagtatgtgtaaggacaaaatattatgtangatagttgcaagatgtggatagacagctatattatgatgattgactggggacttaaaaaaaaaaaaaaaaatgc

SEQ ID NO: 10060 - DNA, 389 bp, Malus x domestica
  Predicted polypeptide sequence is orthologous to G440
tggcaagtatctcatggagcaatcagttgcaaagaagcgccatggttaagcatcctcgcacaacatcgagaacaagtaaactagttcatgttttctacaggacctggagttaaattcgacgtatgttctactataatcataaacaaaaatagtttgcgtagaagtgtattctacgtacaacatggatctttaatcgttaattgtatcatcattttgacaaaaaaccgtattaactggacatttggaaattgaggcttgtcttccattccgttgcttaaccgctgcgatgctctggttcaagcataaagagtgtcaagcaattccaaaatgtacatggtattgtcgtagtgaaagcactaatatttaccctcggatgaggaaaaaaaaaa

SEQ ID NO: 10061 - DNA, 635 bp, Malus x domestica
  misc_feature (539)..(539): n is a, c, g, or t
  Predicted polypeptide sequence is orthologous to G450
ggttttctgaaactgagagtaagattagtactgatactagtacttgtgtggatttgaagcttaatctttctaatagttctaaggaggcaaatagtactggtgggaaagatggcattgctgttaagtccaagacgaacaaggagaagaacaaccaccttgatcttccggcttccgatccagcaaagcctcctgctgccaaggcacaagtcgtgggttggccaccggtgcgttctttccgaaagaacatgttcacgggggtgcaaaagagctcaaatgacggagaaagtgagcagatgaacaagggtggcaataataatgcagttctggtgaaggttagcatggatggtgcaccctaccttcgcaaggtcgacttgaagatgtacaagagttaccctgagctctctgatgccctagccaaaatgttcagctccttcaccattggaaattgtggatcccaaggaatgaaggacttcatgaatgagagcaagctgatggatgttctcaacggttctgattacactccaacatatgaagacaangatggtgattggatgctggttggcgatgtcccgtgggagatgtttgttgaatcatgcaagagattgcgtataatgaagagcaaggaggctgttggg

SEQ ID NO: 10062 - DNA, 854 bp, Malus x domestica
  Predicted polypeptide sequence is orthologous to G450
aacaacgcaacaacgcaacaagacagaagaaagaagaagcagcaacgaaagcagctctacgcatcaccaccaaattaagcacaagcttagagaccctcgcaggctttttatatacaagcactttcttcaaaatttcattattcctgttagccggaagatgacgagcatgcttggagttgagtgtgatttgaacctcagagagactgagctgcctagggctgcctggtggtggtacttctactgtggctgagccggaaactaaggctaccggaaagagaggcttctctgagaccgttgatctcaagctcaagcttcagtccaaggatgatctgaatgacaatgtaaaaaatattgcttccagggagaagaacgacctcctttcttgcacaaaagatccagcaaagcctccagccaaggcacaagttgtgggttggccaccagttcgatcataccgaaagaacataatggcgcagaagaacaccagcgaggaaaatactgagaaggcaaccgtcggtggcggaggctgcagcgctgcgtttgtgaaggtttgcatggatggcgctccatatcttcgtaaggtggatttgaagatgtacaagagttaccaagagctctctaatgccttagccaagatgttcagttccttcaccaccggttactatggggcccaaggaatgatagacttcatgaacgagagcaagttgatggatcttcttaacagttccgagtatgtgccaacctatgaagataaggacggtgattggatgctcgtgggggacgttccatgggggaagttcgttgattcatgcaaccggctgcgaaaatggaagggtcagaagcagttggaacttgcc

SEQ ID NO: 10063 - DNA, 711 bp, Malus x domestica
  Predicted polypeptide sequence is orthologous to G450
tgatttgaagctcaatatttcatctgaagatcaatcggctggtgatgaagatcaagcggggagatgaaggagaagaatgttgctcctgttcctaggtcaaatgatccaactaagcctcctgctgccaaggctcaagttgtaggttggccccctgtccgatcattccgaaagaacatcctgaccgtccaaaagaatagctctgaggagggtgaaaataccaacagcatcagtgcagcatttgttaaagtcagcatggatggcgcaccctacttgcgtaaagtggacctgaagttgtacaaaagctaccaagagctttctactgccttaagcaaaatgtttagctccttcaccattggtaactgtgggtcacaaggaatgaaggatttcatgaacgagagcaaactaatagaccttctgagtggttctgagtatgtgcctagttatgaggacaaggatggagattggatgcttgttggagatgtgccatgggaaatgtttgtcaattcatgcaaacgcctgcgaataatgaagggatctgaggctatcggacttgcaccaagagcggtggagaagtacaagaacagaagttgaagaagttgctagattgccgtgggttgatatttctgccatggacacaatcaaatgaaagcagaccggctctacacagatggagagcacgaggtttggatgtctgtgactctgtatttttgt

SEQ ID NO: 10064 - DNA, 771 bp, Malus x domestica
  Predicted polypeptide sequence is orthologous to G450
tggtggacatgaagaaggagaaggatgttgctcctgttcctaggtcaaatgatccaactaagccccatgctgccaaggctcaagttgtaggttggccacccgtccgatcattccgaaagaacatcctggccgtccaaaaggatgtctcggatgagggtgaaaagaccaacagtatcagcgcagcatttgttaaagtcagcatggatggcgcaccctacttgcgtaaagtggacttaaagttgtacaaaagctaccaagagctttctactgccttaggcaaaatgttcagctccttcaccatcggtagctacgggtcacaaggaatgaaggatttcatgaacgagagcaaactaatagaccttctgaatggttctgagtatgtgcctacttatgaggacaaggatggagattggatgcttgttggagatgtgccatgggaaatgttcgtcaattcatgcaaacgtttgcgaataatgaggggatctgaagctattggacttgcaccaagagcggtggagaagtgcaagaatagaagttgaagaagttgctagattgctttgggttgatgtttcggccatggacacaatcaaatgaaagcagaccggctccgcagagatggagagcatgaagtttcgatgtgtctgtgaccctgtatttttttttttctttttggtccttctaatgtttttaactaaagttaagaatatattctgagatttgttagggacgacaagaagcaataatatatattatagatgttcataaaaaaaa

SEQ ID NO: 10065 - DNA, 812 bp, Malus x domestica
  Predicted polypeptide sequence is orthologous to G450
tcacattgaagtaaaagcaaagcaaaagctctcaaaatgttaccggaaaataagcagcagccgccggacggactgaactacgatgagacgaagctgaccttagggttgcctggttcgggctcgaaacgtggattctcagagaccgttgatattagtcttgggagctcgagctcatcgtcgccaagagcaggggtggaatgttgtgatcaatatagtgttgttgatggtggggacaaaactcataaggctccagctaaggcacaagtggttggatggccaccagtgagagtttcaaggaagaacttgatgaacagctgcaaatatgtgaaagtggcagttgatggagctccatatctgcgcaaggttgatcttgagatgtacaacagctatcagcagcttttgggtgctcttgaggacatgttttcgttcttaaaaatccgtaattacttaaatgagagcaagcttatggaccctgcaaatggggtggaatatgtaccaacttatgaagacagagatggcgattggatgcttgttggagatgtcccatggaaaatgtttgtggaaacatgcaagcggctccggttgatgaaaagctcagaggcgatcggattagctccgaggacgcctccgcaattcacaagcacacactgaaaaaaggccttttactgttttacatatggatgagagagaagaaagagaaaaaaaatggaaaaaataaaaagggagatggtttgtaccggaaggcttttctctttcttgtgttcggggggaaattttggattttaaatgaaaaaaaaaaaaaaaaaaaaaaa

SEQ ID NO: 10066 - DNA, 396 bp, Malus x domestica
  Predicted polypeptide sequence is orthologous to G451
ccgattttttttttttttttttccgtttatcgtttcttttctttgtacaactctccttgaagagaacatgaacaaactatacatgaaaatttgccttgttcttctaacaattccttgtaaatattttctattacaacataacaaagtttctgtttctaaatcgaaagcccgagctggatgtcttcatgaaagcaaacatgactgtaaatcttctgattttgtctaattgttctttgatcacggcgtgcagcagcctaaccctttcgcatccgaacctttcatgattcacaacctcttgcacaaaacgatgaacatctcccatggaacatctcccccaagcatcaaatcacaaactttgtcttcataagaaagcaaaaattctgatcggctattata

SEQ ID NO: 10067 - DNA, 587 bp, Malus x domestica
  Predicted polypeptide sequence is orthologous to G451
gaaaaatcatggcaatgtttgcgcaggatcttgaagccacggagctaagattagggttaccgggcaccaatgattccgagcagaacacctcttctcctactttggttagcaagagtaacaaaagaccactgcaatccgacatgaacgaagacaatgattcttcacccgccaacagatccgacgagcaaatttctcagcctccacctaccaagacacaagtagtagggtggccgccggtgagatcatactggaaaaactgcctccaatcgaagaaaaccgaggcggaggcagccggcatctacgtgaagataagcatggatggagctccttatctaagaaagattgatttgaaggtgtacagaggatatcctgagctgcttaaagcattggaagacatgttcaagttcaaggttggtgattactgtgagaagaaattagggtataataaccgatcagaatttgtgcctacttatgaagaacaaaatggagattggatgctacttggagatgttccatgggagaagttcatcgtttcgtgcaaaaagttgagaatcatgaaaggttcggaagcgaaaaggttaggctgc

SEQ ID NO: 10068 - DNA, 556 bp, Malus x domestica
  misc_feature (187)..(187): n is a, c, g, or t
  Predicted polypeptide sequence is orthologous to G451
ctggttggagatgttccatgggatatgttcatgtcatcctgcaagaagttgagaatcatgaaaggatcagaggccagaggtttggggtgtggcgtatgaaaaagacatgtcaacccaaaagatcaaggggagaaggaaagatatatcatctctctctctctctctctctctctctctctctctctcnatctcatgatatgcatggagagaaaaatttacctcacagcttgggtaatcgacgaagatattcagattttagtctccttaatgactgacatatcttctctggagttgattgggattgtaaacagaagcagaagataatctagctggtgaagtaattacaaattcattccttaagtttggcacctagatttgtttgcggtttgcgcatccgtgattgatgctgtatcgtattgtttcttatgattcagtcagaccaaaactgcataaagagattttggttctaaagagatcgtataaaaaggaagaggcttgtttcatgttttggctatgagtttgtactattgatatttgatatggatcaatatatatg

SEQ ID NO: 10069 - DNA, 665 bp, Malus x domestica
  Predicted polypeptide sequence is orthologous to G451
ttcaaaatctctcacaagaaacccttaacacacctttctgtttatctattatccttctgcaaatcagtctgcaatctgcaaaagcattagggtttatttagcaaagtgattaagatggaagaccagctaaatttcaaggcaactgagctaagattagggttgcctggaagctctgaagagcctgagaacaaaaaagcagcaccgtctcctcctatggctaagaataacaagagggcttcgccggattcagcggctgaggagtgcagtacaagttctgatcccatagatgtccctcccaccaagtaagcaatgttcatacatggactatgagttttatgttaataattgattaagaaggtttagttaagtggttatgttgctaatttatgattgaataaatgtgagcaggacacaggtagtagggtggcctccaatcagatcttacaggaaaaacagtttgcaactgcgagaggcgtacgtgaaagtaagcgtcgacggagctccttatctgaggaagattgatctcaaggtttacaatagctaccccgaactcatcaaggccttagagaagatgttcaacctagccaatattaatggatccgattttgctccgacatatgaagacaaagacggcgactggatgcttgttggaaatggccatggaa

SEQ ID NO: 10070 - DNA, 655 bp, Malus x domestica
  Predicted polypeptide sequence is orthologous to G451
ccctctcctcaaagcctccatcaccgaatactcacgacttggttatttgctagttcaccgtcaaagtttgagcagaagaacaatctttgaagaaacacacagagaaatcatggcaatgtttgcgcaggatcttgaagccacagagctaagattagggttaccgggcaccaaggattccgagcagaacacatattctactactttgattagcaagagcaacaaaagaccactgcaacccgacatgaacgacgaagacaatgattcttcatccgccaaaagatccgaccagcaaatttctcagcctccaccttccaaggcacaagtagtagggtggccgccggtgagatcataccggaaaacctgcctccaagcgaagaaaaccgaggcggaggcagccgggatttatgtcaagataagcatggatggagctccttatctaagaaagatagatttgaaggtgtacagagggtatactgaactgcttaaagcgttggaagacatgttcaagttcaaagttggtgattattgtgagaaggatttagggtacaataacagatcagaatttgtacctacttatgaagacagagatggagattggatgctgcttggagatgttccctgggagaagttcatcgcctcctgccagaaggtgaaa

SEQ ID NO: 10071 - DNA, 591 bp, Malus x domestica
  Predicted polypeptide sequence is orthologous to G489, G714
accagcaacaacaacagcaactgcagcaacaactccaaaaattttggggagagcagcataaagaaattgatcaaactaatgatttcaaaaaccatagtttgccattggccaggattaagaagattatgaaagcggatgaggatgtgaggatgatatcagccgaagctcccgtcatatttgctagggcctgtgagatgttcattctagagttgacaatgcggtcttggaatcataccgaggagaacaaaagaagaacactgcaaaagaacgacatcgcagcagcaattacgcggacagatatatttgactttcttgttgatatcgtcccaagagaggatttgaaagatgaagtacttgcatcaatcccaagaggtgggaatctcccagttggggttccatctgatggtgttccttactattacatgcctcctcagcatgctccacaggttggtgctccggggaatcaaaatatgtatggccaacagacacatgcgtacattgctcaaccaacatggccacatcaacaacagcaaccgcacgaagatatcgagtaaaagagataatggagtataaaaccagaacatcctttga

SEQ ID NO: 10072 - DNA, 609 bp, Malus x domestica
  Predicted polypeptide sequence is orthologous to G519
atctgagaagaagcaaattagcaagagcaagaggaaagagaagaagaaaggaaaagggaaggagtaaaagcgaaacagtaaaaagtaatcatgagcggaggaggagacgagcagcagcagcagcagctggagttaccgccggggttcagatttcacccgacggatgaggaactggtgaaccattacttgtgcaggaaatgcgcttcacagcctctcgctgttccaatcatcagagaaattgatctttacaaattcgatccgtggcagctccctgaaatggcactttacggagagaaagaatggtatttcttttcgccaagggacagaaaatatccaaacggttcaaggccgaaccgggcagccggaaccgggtactggaaggcgaccggggctgacaagcacattggaaaacccaaggcactcgggattaaaaaggcactcgtgttctacgctggtaaagcccccaaaggaatcaaaaccaattggatcatgcacgagtaccgcctcgccaatgtcgaccggtccgccgccgctgccaagaaaaatcaaaaccggaagcttgatgattgggtactatgccgcatatacaacaagaaggggcacatagaa

SEQ ID NO: 10073 - DNA, 583 bp, Malus x domestica
  Predicted polypeptide sequence is orthologous to G519
cgatatcagttccgatcattgccgaaatcgatctctacaaatacgacccctgggagctcccaggcttggcgttgtacggggaaaaggagtggtatttcttttcgccaagggatcggaagtacccgaacggttcgaggccgaaccgggcggccggaagcggctactggaaggcgaccggggccgataagccgattgggcacccgaaacctgtggggattaagaaagctctggtgttctatgctggaaaagcccctcgcggcgaaaagaccaactggattatgcacgaataccgcctcgccgacgttgaccgctcgccgaggaagaagaacagcctcaggctggatgattgggttctgtgccgaatatacaacaagaaggggaccgtggagaaccagcagcctcagcagcagcaagaacaacagcgaacgactagtcgtaacgcgagcagtggctcggagttcgaggacaggaagccggataatctgaggtgcccgccgccgccggcttccgtggtccccagtcgtcacgtgagcgattacgtgtacttcgacaactctgactcggtgccgaagctgcacacgga

SEQ ID NO: 10074 - DNA, 719 bp, Malus x domestica
  misc_feature (639)..(639): n is a, c, g, or t
  misc_feature (682)..(683): n is a, c, g, or t
  misc_feature (693)..(693): n is a, c, g, or t
  misc_feature (700)..(700): n is a, c, g, or t
  misc_feature (705)..(708): n is a, c, g, or t
  misc_feature (714)..(718): n is a, c, g, or t
  Predicted polypeptide sequence is orthologous to G559
actgctgagaacagtgaactgaaactgcgtttacaaacaatggagcaacaggttcacttgcaagatgcattgaacgatgcactgaaagaagaaattcagcatctgaaagttatgactggccaagctacgccaaatggtggacctatgatgaactacgcttcttttggcggggcaggtcagcagcagttctatccaaacaatcaagccatgcacactcttctaactgcacagcagtttcaacagctccagattcattctcagaagcagcagcaccagtttcagcagcatcagctccatcaactccagcagcaacagatgcagcagcatcatcagcatcagcaacagcaacagcagcagcaacaacaaagtggggagatgaaaataggaggatccgtgccttcgccaagccagaaagataatacatcagaggtcaaccaatctgtaacgaaggattgaaatgttatcgggtctgccaaaaattaaagacggttgaggcattgttcaaaaattgtagttgcacagccgcctccggttagggtacttaccctcccttcccttcctcccccttctgtttttgagtctggttagatacacctagacgacaccctttgttgtagcctgttctgtacatatcgtttnaagtgtaaatcgaatgatggggttaatttttcggtgaataccnnatgggtgtancccttgngattnnnngtttgnnnnng

SEQ ID NO: 10075 - DNA, 714 bp, Malus x domestica
  Predicted polypeptide sequence is orthologous to G653
ccatatccatccgcttgccatcacactccttccgtacggaaaaggacccatttgcccttcctcacccatttcgttttcaaaatcttttcttttttattttaccctttttaattatcgagatttttgagcttcactcagtcagccttaaagcttcaaagggtggaaggttgagagggggtgatcttggtaaaaagagaagaatcagatctagaaggagatagaaatatgtctttcattggcacccagcagaaatgcaaggcttgtgaaaagacagtttacccagtggaggagctatctgctgatgggatttcctaccacaagtcttgcttcaaatgcacccactgcaaagggactttgaagctgagcaattattcctcaatggaaggtgttctatactgtaagcctcactttgagcaacttttcaaggagactggcaatttcaacaagaactttcagtcacctgcaaagtcagctgagaagttaactccagagctgactaggtctcctagcaaagctgctagcatgttttctggaacacaagacaaatgtgctacttgtggtaaaaccgcttatccgctggagaaggtgactgtggagagccaggcctatcacaagtcgtgtttcaagtgttctcacggcggctgtcctattactccctcaaactacgcggctttggagggcattctatactgcaagcaccatttctcccagctt

SEQ ID NO: 10076 - DNA, 692 bp, Malus x domestica
  Predicted polypeptide sequence is orthologous to G663
tgtgattggtgtagatggtctctaatagcagggagaattccagggcgaacaaaagatgaaatcgagaattactggcacagtaatttatgtaagaaacagcatgaggatcatatattatcatgtagaccctccgcctccactgagatcgcagacacagtacaacagtcaaaagttgaagtgcaattagaaaatgaccccagttgcaataataattttgcattggggtcctccatgccttgtaatttaactgacatcatggcagaagagtctgaaacaagtagtgggtcattactgtcagcatcaaagtcgagggaagaagatcgttccagctgctgggaaaatattttgatggaagacttccacacgagggagatgagcctctctgagtttctggatactgactttacaaagctaagcaatgtgtttgggtttgggatgtgtgatgtcatgagcaatgaggtgttacttgaaggagaatctggctatggattctgacgatggatcttagatgcatggctgcttaatttcactgacttaaaggaataatggatgattatgtgctaaataacaaatatgtatttgccaaatggcattgtcgaaatcctgcgtattatataacactgaataaattagttgcctagggttttgcttcagacttgtgctatgcgctttagaaaataaaaaatgcaagg

SEQ ID NO: 10077 - DNA, 634 bp, Malus x domestica
  Predicted polypeptide sequence is orthologous to G675
tgatccagatgggttttgatccaatgacccatcagccaagaactgacctattttccaacttgtctcagcttagccctagctaacctgcaggatctcatgcagcaatatcagccattagatcacattaatcaacatgatgcaacattacacgcagatcaagccgttcaattgaccaagcttcaatacattgagcatttactccaatccgtagcttatacaagcaacaatgacacttatacccagaacagaagcacagagatggaaatggatgatcaggcttttaatttgttaagctcgattaatattcctcctagcaaagaaaccccgaattttaattcactacaactggaaaatccaagctcattttctcatggatatggtggtaattcttctcaaccactccaccatcttcaacccctactgcctcatgacctagcagacccacaagtcgctttcagttctctaccatctttgaataacagtaaccatgaagtgggccagggctccaactttacagtggtccgtgttcaagaaaagaacccatccgatgaatcttcatggtttaataatcttgtatctcctaccgctccttctattcctccaaccagcaatgttcccggaaatgcgtactgca

SEQ ID NO: 10078 - DNA, 667 bp, Malus x domestica
  Predicted polypeptide sequence is orthologous to G720
tccttatagtcacaggcctatcatggccttccccccgtatcattacaccaatcccaccctatcaatgcctccagcctatccaatgtggggatcacaaccacctgccagcagtcatccggccactgtccagatgtggggccaacctggctatccccactcccagtggcaaccatcagatcaaagttggcagtactggaacccttatccagggttacaagctgatgcatggggttgcccagtaatgccacctgaacaaggtggctattccccctatcctcaaaacacatcaggttttcaaaatgcaggaggtcatgcagttgaaaactgccatggttacagcatgccacaaaactctttcgacattcatccggcagaagaagttgttgacaagattgtgaaggaggcaatgagcaagccatggctacccctccctctgggccttaagcctccttccactgaaggtgtactagctgagctaacaaggcaaggcatctgcaacattcctcagatcaacggctccaacacccgctgacgtcgcggaccttgtcccatccacaaggctagtgtggtggtcctcctctcacttcactcagccaaatcaagtcgagtccataaccatgtgttctgtcaaattttaacatgtattggacgcttgatttgtgaacga

SEQ ID NO: 10079 - DNA, 367 bp, Malus x domestica
  Predicted polypeptide sequence is orthologous to G730
acaaaatacccagaaatctctccaacacctgaaaatctctaaccctaatcagatcaccaaggaagctatctagctagctcacacaatacatatatacaaacacacagagttatttcccagcacaaggaagaagaaagtgctcataaatatacaggagggaattgtaaagtagctagatatatctgtatagggtttaggagaaggagattaagagagggaggtggtttgatggagttgttccctgcacaaccggacttatctctactaattagccctccaaacagcaaaccctcgtcctcctcctcatcaactagttggaggagaagcagtcatcaacgtcatcaggagggggtggatttggggtttt

SEQ ID NO: 10080 - DNA, 593 bp, Malus x domestica
  Predicted polypeptide sequence is orthologous to G732
cctaagatatacctagattatatatattcgtgtataattatcgaataatttagtatttaatctaagtttttatataaatcttcatatatttctatggcttcttcaagcggaaattcctctggttccgctcagcttcagaactatgcctctgaaggggatctgcatcgtccggtggatcaaagaaagagaaaacggatgcaatcgaaccgcgaatcggcgcggcggtcgcggatgcggaagcagcagcacctggacgatctgatggcgcaggtcgcccagctgcggagggagaacaaccaaatcctgaccagcataaacatcaccacccagcacttcatgaatgtcgaatcggaaaactcggtattgaaagcgcagatgggggagctcagccagagactggagtccctcgacgagatcctcggttacatcaacggcggcgtcggccacggcggaggccttgaaaccacccctgttgccgatcagaacagtttcataaacccttggaatatgcttcatgtgaaccaaccaatcatggccactgctgacatgcttcaccaatactattaattaatccatggccacgatgacaacag

SEQ ID NO: 10081 - DNA, 657 bp, Malus x domestica
  Predicted polypeptide sequence is orthologous to G732
cacgaggattaaataaattggcaacaaaaccagaagccaaaaggaaaacagaagtatcgcttacacatccttacatgttcaacagtaaaacaacaacccatgacctacccatcaatcattgtacgaacaaatttacaaaagccatggatgttctaagtagttaaaacttacacctcaattaatttcactaatctctcacttaatccatgattaacccgactgagtttagcacataaacatgtctgcagaggccatgattggttgattattcaaaaagccagtactccatgggttcagaaacccatcacctccaccaataatattatgattatcttcttcctcatagatccatttgcttgaattaatacaatccataatatcattgagagactgcaatctgtttgtgagctcatccatctgagctctgaggactgagttttctgcctcgagcttcatgtaaagctggttggtcacgttcatggatgtgatgatctggttgttatcccttgtcaggagaccaatctgagcagtcagatcagtcagatgctcctgttttcgcatccgggatcgacgtgccgattcccggttggacagcattcttttgcgctttctctggtccatgacttggttaagatcttcatcagaccctgagttttg

SEQ ID NO: 10082 - DNA, 635 bp, Malus x domestica
  Predicted polypeptide sequence is orthologous to G748
ccgattttttttttttttttttgaacaaaaagatctttgaatttcacatatatagagatatagacatgtacatgaacacgaactcaggaaaactaagtacatcagagctttatcctgtgcattacaaggaggcaaaaatagttgccactagagctttatcctacattagttcccctatcatactgaggaaccctagagagtagagacagcccctctgattccgcatcccggattcgaccggctcaactaaaatggcctttagctggatggggttctgccaaaactcgtggctacttgactagctagctacttcatgagctctcatgaaagttgagggatctagacaacgcagctggatttgctcgcaaagcgggagaggattcagaaacggttttctttttgtcactctttgactggaaagccttaaacaaccctccgccactgatggaatcgttcttgattccgagcgttgcccatattgaactctttggagcttcactcggatcatcaatccctaatgtttttggaacccaaaacaatccatttttctgtcgtgatggctcttcttaaccgcaaatttctggttttagaacgtcttcactccttgaaggcttccccaacgttggaaaatttga

SEQ ID NO: 10083 - DNA, 610 bp, Malus x domestica
  Predicted polypeptide sequence is orthologous to G748
gaacgaagagcctgcgaaagagaacagttccgaaagatgtgtttggatcccaaaaactttaaggatcgatgatcctaatgaagcagcaagaagctctatatgggcaacactcggcattaagaatgaaaagggaaactgtaccaatgagggaggaggtctcttcaaggcgtttcaatcaaagggagatgagaagaatcacgtggttgaagcttctccagtgttgcaagcgaaccctgcagcgttttcccgatcactcaacttccgcgaaagaacatgatcaaagctgaagtctgagtggtaaacttcggcaatgtgatgcaagggggtttacctccctccaacctttgctgctgacaaatatgacaccttttttttccattttcttttttaccgtaaggcaatgtttactgatcagcctcaatgtttctgagttagatcatatagatgtattttcttgaatctctgtgtaacattatggataggtcctttttgttttcacctcagttagttgctgcagaaagtgtttttatacatatttaggatgtgaggtaacataagatagctaataaaacgagagatatttggatgtaaaaaaaaaaaaaaaaaatcg

SEQ ID NO: 10084 - DNA, 600 bp, Malus x domestica
  Predicted polypeptide sequence is orthologous to G748
ttctttttttttttttttggatctccaaccaattctatcatagtatttcacatatatagagacatagatacgtacatggacataatctcagaaaaactaagtacatcaaaagggacctgtgcatagcgcaagaaggcaaaaatagttgccactaaagatttatcctagtgggaaccaatctcccacaagcgctttatcctacattagttcccctatcatactgaggaaccctagagagtaaagactgcccctccaattctgcatccccgattcgaccagctcaactaaaatggcctcagctggatggggtacctgtcaaaactcatggctacttggctagctagctacttcatgagctctcgtgaaagttgagggatctagacaatgcagctggatttgctcgcattgcgggggaggtttcagggacagttttcttttgatcactctttggttggaaggccttgaacagtcctttgccactgatggaatcgttcttgatcccgagcgttgcccatattgaactctttgcagcttcacttggatcatcaatccgtaatgttttcggaaccaaacgcatccatttttctgtcttgatggctc

SEQ ID NO: 10085 - DNA, 410 bp, Malus x domestica
  Predicted polypeptide sequence is orthologous to G783
tagcaaaagctaagtgtgggggaatttgataggagcatatttatgcgccttagttagctagttcttatgcatctttgttatgttttctttgttaaagtagtcttttaagctacttccatgtgttttcaggtttaaaggacatattacatgaaatgatgcaagttggagcttttggagcaaaatatgagcttggattgaaaaggacatgcttggaacacaaggttgggatggaattgatgagttgaagatttgaggtttcctacttgaagtaggaaagctaagcctaaaagtttccattttgggttgatctttcctaaatcggaattggcaaccaaagtttctaaagttggaagtttctattcttggagggttccattttcgtgagtttctattctcgctttgggcttcta

SEQ ID NO: 10086 - DNA, 179 bp, Malus x domestica
  Predicted polypeptide sequence is orthologous to G881
gatcaactactgaaacttactgatggtgctgttggtgatgatcatgatggtcttcgtcagccacttttcattctgcaggtacctgcgcatataatttgggtcatcatcatttgttctgcataaagctagctaacaagataataaagcagttccaatttgtttgcaaaaaaaaaaaaaaa

SEQ ID NO: 10087 - DNA, 624 bp, Malus x domestica
  Predicted polypeptide sequence is orthologous to G896
atgcgccgtgtcgtataagcggtcccggcacgaactcaagggctgcattaacgacgccaagtgtatgaagtacttgctggtcaacaagttcaactttcccgagtcctccattctcatgctcaccgaagaagaagttgatccttataggcgcccgaccaagcaaaatatgagaatggcaatgtattggcttgtgcaaggttgtcaaacaggggattctttggtgtttcattattctggtcatggatcacaacagaggaactacactggggatgaggtggatggatttgatgaaacgctttgtccttcggattttgagactcaagggatgattgttgatgatgagatcaatgcgacaattgtcaggcctctacctgctggggcaaggcttcatgcaattgtggacgcttgtcatagcggtactgtgctagatttaccatatctctgtaggatggacaggaacgggaagtatgtatgggaggatcatcgccctagatcaggtgtttggaaaggaacaaacggtggagaggccatttcctttagtggttgtgatgatgatcaaacctctgccgatacctcagctttgtccaagattacttcgactggggccatgactaatgccttcat

SEQ ID NO: 10088 - DNA, 672 bp, Malus x domestica
  misc_feature (603)..(603): n is a, c, g, or t
  Predicted polypeptide sequence is orthologous to G896
agaagccaaatcattcgctgtgatgcgtgtgaaggcatcacccgcattagtagatcatccgtcaatcctctgatccgagcaggccaagatacaataaaccacactgtcaaccgtgttaaaagccgaatgactagagtgatgtccatgccctccccgaatgctgcccgccctgctaatcctcaatactaccagcatcagctgtcccagccatttgtaccaaaacccttgatgcctccttcggcgtatggaagaaagcgcgcggtgctgtgtggagtgagttacaatgggaaaagttacaagctcaaaggaactgtgaacgatgttcactgcatgaaatactttcttgttgacagattgggctttccaaatcattccgtactcttgctcacagaacatgagacggacccttttaggatcccaacaaaacaaaacatgcgaatggcgttacagtggttggtgcagggctgccaatcaggagactcgttggtgttctacttctccggccatggctcaacccagcctgactattcgatggatgagattgacggcatcgatgaaacggtgtgccctgttgatttcgagaccgaggggatgatcattgangatgaaattaacgccacctttgttaggcactgacccatggtgccaacttcatgcattatcgatgcctgc

SEQ ID NO: 10089 - DNA, 651 bp, Malus x domestica
  Predicted polypeptide sequence is orthologous to G921
ggtggagatgattcatcacgtataagagtcatagtccggattggagagagacgttcgactccacgtgtccgctgaaccagttccgaagtagcaagacgagtgaatgaaggcgctgtaagcggaagtgaatactcgttccatggagacagatagatagaaagtgtgcagtgagggatctttctaggtagtaactactcgtacagaaaggagtcccaatgtccacagatctgtgccttcaagagcgtttgctattgaatgtgctcttgtcgcaattgaatcagaatctgcagctattgactcagctgctctcgaagttgctctttgcgcactcataggtgtgggactttcttttttcgttttagtaaaatgcctccggcagcagcaaggctatcttaaattccaattttcaatgattgaaatgcattcctctgtattctgttgtgctcagcgaacgggtaaaacccaggatgggaagtcgcatctctttcggagttgaatcgggaatcctactttaaaaaagaatctaatcatgggctctcaggtggcaaaggtctgccttaccttaccgctttccagtcatccatgctgctcctacaagaaaagggtcttcggccagctttccagaaagaaaggaattactaaatacagaaa

SEQ ID NO: 10090 - DNA, 617 bp, Malus x domestica
  Predicted polypeptide sequence is orthologous to G937
ggggaggggccttactggcattcaagggtcagaatgagttgtctggttttgcaaacccacgtttgaagggagacaaggaggttaccgtggttccaaacctttgtcttatgactccattgatgtctgaagcactggctggttctgcaaatgcaaactctaagaccaaccatggctgcagaggtggcggttcgggttctggtatggcaggacaattgaaattacagaacaaaccccaacagcagccacagcagcagcagcagcaacccttaaggaaacaaaggcggtgctggtcggcggagctccatcgccgctttgttgatgcccttcagcagcttggaggaacacaagccactcctaagcagataagagaacttatgcaggtggagggtctcaccaatgatgaagttaaaagccacttgcagaaataccgccttcacatccgaaagctcccgccttcttcggctgctggccaaggcaatgacttactcgtgcccgtggatcacagtggagagcatactaaggcaaacaacgcacagtctggttctccacagggtcctctcctcgcaggagggtttgccaaaggccgatccacaactggaggcgagtcgggcgacagc

SEQ ID NO: 10091 - DNA, 645 bp, Malus x domestica
  Predicted polypeptide sequence is orthologous to G938
ttggaattgctgaggatgggcagaaaatgatatccgagcttatgtcattctatgatagtaatatacagcaaaacaagaactgcaatcctggaaacctaaatgatgtagatgattgcaatcagcagcaggctaactttcaatttccaatgaatgataacttatgtggtcaagggctggacataggacgcaacatgaacatgtcggaacagtcccccatgcctatgcttcatccagatttttcatccccggaagttcagtttgatcaattgatggcatttgattctccatttggtaacaattccaacgaagatgtcgacataagatttggctcccccttgcacttgtcacctgttggttataatgttatggacccgcctctgaaccaagacccctggttcccatgaagtgggtttttcttatattgactgctccaatatatacgcgttggagtcccacagtttaggtgaagcttcttttcaactttacttgcttctcttatcttttggacttgttagatgtctatatgcctaatatgtcataacccaaatctgtgtttgcgggtggtttacacggttgagcaaataaagaagccttgttgtgtttagttgcttatttatctgctggactttttagacgtttataacc

SEQ ID NO: 10092 - DNA, 602 bp, Malus x domestica
  Predicted polypeptide sequence is orthologous to G962
taaacttctggttcatgacagtatgtgattcaattgtccttatgtatgtataatacaattcactcgacaaaccacgtaacttctccaatatacgcttctgggtatcattggaggtaatgcatatatactccacattttttgcatttttcatttcaatgtggtatccatttaaacgtatgtctttgaaactcaacaaatttcgagtagatcgagtagcatacaatgcattctatatggacaatattgttccatttggtaacataatctgagctttccttgagtcttcaattatatttgattggcctaatattgttgttacccttactcttgtaagcatcaagcttaagaaataattttgatcacgaagtattgtatgtgtggttgtgttgtctacaagacaaatatctgcaccatttctcatgttctaagaataaccatagtttttatccatactttctgagtaaatggaatcacagttaacaaacaatttataatagaaaattgaaatgctagttttaaactacaagtttagaataataatagtacatcaaacataaatgattcagttagaccgatacacttcattcctcctttccacaatg

SEQ ID NO: 10093 - DNA, 503 bp, Malus x domestica
  misc_feature (481)..(481): n is a, c, g, or t
  misc_feature (489)..(489): n is a, c, g, or t
  Predicted polypeptide sequence is orthologous to G975
agttctgatcatgatcatcaagaggaatcactgtcatccttgacgtcatcgtcaatggtggggttgactgagggtggaatgagtgaggcagatcaggatgaagaggataaacttgcaatgcagatgatagaggagttgctgaattggaattatccaataccttcagccacaagtaatgttcacgaaggaaataatatttaaagggaattctatatgccggagttcttaaccgttaagttcttgataaaaaacaataattggaatttaacagttaaaaatttcgaagtatagaatatttcaaagtacagtagaaatatcgatagatattaccaaccatctgagctgcttgaattcctagtgttattagtcctcgaagtaaggaggcagttaagtgctcaatttgcagctacgtacggtagttaattaaatcataaaatgccaccacactgttgttttgtgattggtgattaacttgtagaanaaaaaaanaaaaaaaaaaaaaa

SEQ ID NO: 10094 - DNA, 433 bp, Malus x domestica
  Predicted polypeptide sequence is orthologous to G975
ggtgaaatcgaaaaagtacagaggcgtcaggcagcgccactggggctcttgggtctcagaaatccgccaccccttactgaagagaagggtgtggctaggcacatttgagacagctgaagaagcagcccgagcatacaatgaagcttccgttttgatgagcggacgaaatgccaagaccaatttcccaataacaactactacaactcatagtaatggtacccgtaccacagtaggatcatcagatcacccaaaaactagtagcggcgacatggattcacgatccgaacagaagggtctgtcggaaatcttgcatgccaagctaaagaaatgcggcaagataccatctccatccatgacctgcttgaagctcgacaatgagagctctcatataagagtatggcaaaaacgtgcaggtcaacgctctgataactcc

SEQ ID NO: 10095 - DNA, 335 bp, Malus x domestica
  Predicted polypeptide sequence is orthologous to G976
tggagagtccaaaaatgggacagatgcagaaacacgaggttgatgatatgatgatgagtagtacaagtttggcttcttctgtaggatactttatggacgaggaagagcttttccaaatgccgaacttgctggtggacatggcagagggaatgctggtgtctccgccgagaatgaacgactctccaccgtctgattatgatgacttgccgggaaattcagacggaagagaaggtcgtctgtggagctattagtgattatgcagctcacaccctaaattaattcacgctcaaaaataaagataattataacatgaaaaaaaaaaaaaaaaaatcggt

SEQ ID NO: 10096 - DNA, 184 bp, Malus x domestica
  Predicted polypeptide sequence is orthologous to G988
ctagcctttcattttcaagaataaaaccatataaaagaaggaaagaaagaaagacgagaataattacggacggtcgaacctgccaagccttggtcaagctgtttcgtatgtatcaatagttcacaacaaaagatggcacatatttaattactgaaaggagtttggttttttgtaaaaaaaaaaa

SEQ ID NO: 10097 - DNA, 726 bp, Malus x domestica
  Predicted polypeptide sequence is orthologous to G993
cgttgctgtcgagccctcatccgccgaacccatttcctccgacgacgaagaaaacgacgacgccgaggccgcgtttctgagctcccactctaagtccgaaatcgtcgacatgctgcgaaagcacacttacaatgacgagctggaacagagcaagcgcaacaactccgcttatgggaagcggtctcggtccaacggatcactgggcctgttcggtacggacaacagtggagtcccgaaagcgcgtgagcagcttttcgaaaaagccgtgaccccgagcgatgtcgggaaactgaaccgcctcgtgatcccgaagcagcacgcggaaaagcactttcctttgcaaagcggaagcgctgcaaccttaacggtaagcgcttctaccgcttgcaaaggagtgcttttgaattttgaggatgtcgggggcaaagtgtggaggtttcggtactcttactggaacagcagtcaaagctacgtgttgaccaaagggtggagccggttcgtgaaggagaagaatctgatggccggggacattgtgagctttcagaggtcgaccggaccggacaagcagctgtacattgattggaaggccaggatgagtgtgaataataccaacaataatgggtcaagcccggttccgatggttcggctatttggggtcaacatattcaaaaatacctgggagcagcgggcccgggtcagcggatgcagctgcagctgctgctatcg

SEQ ID NO: 10098 - DNA, 763 bp, Malus x domestica
  Predicted polypeptide sequence is orthologous to G993
ttttttttttttttttttcaaattaatttgttgcacctaatttcaaaagctttgctttcttcagctcagcttttttctttttgtcatctaatatacatttcacctttcttgcagcttcacagaatgctaaaaaaaacaaagaaaaattttaaaaatgctacaaagctccgatgatcctaggcttcttgctaaactctaatttcaaaaactccatctctctcattcttttgccgatattattattgcaaccgccgccaatagcagcggcagctgcagcatccactgggccagccccgctactcccaggtattttgaatatgttgaccccaaatagccgaaccatctgaaccggtgcaagctgaccttgaaccgggttcgacccattactgttattatacacactcatcctggtcttccaatcaatatacagatgtttgtccggtccggttgacctctgaaagctcacaatgtccccggccttcaaattcttctccttcacgaaccggctccatcctttggtcaacacgtagctttgactgctgttccagtaagagtatcgaaacctccacacttttcccccgacatcctcaaaattcaaaagcactcctttgcaagcggaagatgcacttaccgttatggttgcagtgcttccgctttgcaacggaaagtgcttttcggcgtggcgcttcgggataacaaggcggttcaccttcccaacatccctgggggtcacgggttttttcaaaaactgctcacgcgcttt

SEQ ID NO: 10099 - DNA, 467 bp, Malus x domestica
  Predicted polypeptide sequence is orthologous to G993
tttaaagcaccttcttatctgtcattctatctctctgtctctctctctcctctccaccttcgaacacacaacatacataatcaacgaaacaagaacaatggatggagtaagtagcacagaagagagcacaaccagtgactccatatccatttcgccaccccatcatattgttacacgtgtggagccacttgccaagtcagcgccccaagtggacagcctctgccgcgtcggcagcggggccagcagcgtgattctcgactccgacctcagcagcggcggcggcggcactggtggcgtggaggccgagtcccggaagctcccttcctccaagtacaaaggcgtggtcccacagcccaacggccgttggggggcccagatttacgagaagcaccagcgcgtctggctgggcaccttcaacgaagaggacgaggccgctacggcctacgacgttgctgcacagcgcttcc

SEQ ID NO: 10100 - DNA, 879 bp, Citrus sinensis
  misc_feature (38)..(40): n is a, c, g, or t
  Predicted polypeptide sequence is orthologous to G1006, G22, G28
ggggaaacacagtacagatcactctcaaatccaagaannnacagcaaaatcataacatcatattccccggcaaattaaattcaagcttaacttttcgtttacagattaaagtttcagcttcagtgatacacataaactcttgaactcaagccctaactctgattcaatccattgaaatatggaggattgcgaagctttacacgacactgttaaggaggggtggatttcgtttgatcagcttgatggaaagtcgacgcctcatgctccgcctcaggctcaggctagtggatttcgtttacagaaggcagccacgatgacacgtgagattcacgtgcgtgtaaattatcgaggtgtgaggaagaggccgtggggaaagtttgctgcggagataagggatcgtaaaaagaatggctcacgactttggctggggacctatgatacgcctgagggtgctgcgttggcttatgatagagccgctttcaagatgcgcggctcaaaagccaagcttaattttccaagcctcattgcctcaaacgttgagcctcagcctcacggaattacgaaaaagaatatggcttcttcttcgtcatcctcatccatcgctgcagattaaatctccgaatttgggtttaattagctgagaaataatatttctacttatttttgaagtaattgacattaattcgccttttattaatattaatgttgtgtgtatatatatgtatgtatgtatgatgtatctgccctgcttcatgtatcgtttgggtgatttgatgatccgtaattgtaacaactggtgcaattcataacttgaccccagtccatcgatcaatgtacgtaacgattttcttaaaaaaaaaaaaaaaaaaaaaaaaaaaa

SEQ ID NO: 10101 - DNA, 760 bp, Citrus sinensis
  misc_feature (13)..(15): n is a, c, g, or t
  Predicted polypeptide sequence is orthologous to G1006, G22, G28
gcgggccttcagnnncattaccaatcaacaataatgaaacattaaattcccctgtttcgagcttcaatagtttctccttcacagagaatatcaatgagtatctatcacaaggggttagctctagctcgcactcctccttacatgacggcgtcaatggagggtggatttcgtttgatgatcagcttggtcgtaataatgatattggaagtgcaatagcaaatattgatacgagtatgacttctcctcctcatcctcctcctcttccaactccacagatggatgtggcacgtgggactcacgtgaggatgcagtatagaggcgtgaggaggaggccgtgggggaagtttgctgcggagataagggaccctaagaagaatggggcaagagtttggctgggcacctatgatacccctgagggtgcagcatttgcttatgatagagccgctttcaagatgcgaggctccaaggctaagctcaattttcctcacctcattggctcaaatgttgagcccccggttagggttaccaagaagcgtgggtctccagagcctccttcctcttcttcgtctctttcttcatcatcatccgttgtgtcctttagacccgggtgaattaattattagtatcagagctgctttgcttaattttcttagattcaaatttacataacatgtaatcgtacttcttcttaataatttcttttcaaatcgattgccccgtttaccccccgaaaaaaaaaaaaaaaaaaaaaaaaaaaaaa

SEQ ID NO: 10102 - DNA, 731 bp, Citrus sinensis
  misc_feature (689)..(690): n is a, c, g, or t
  Predicted polypeptide sequence is orthologous to G1006, G22, G28
ggggaaagttgcaggtagcagttgcacactcacaattcacaaagaaagttaacgacaaggaataggaaatatatacataaaccaatttctgtttttaaatccggaagcaaaatgcacggacacagtagtagtggtggtagtatgaatatgatgccgtcggattatgctgtgctggattcagttcgccagcacttactcggcgaatcggagactggactgagcagcgtgtcatcagcgagttccaagtccaacggggctccccctacttatttcaggagctcaagctttagccgattgtacccatgtctaacggacaactggggggacctccctttgagggagaacgactccgaggacatgcttgtctttaatttcttgcgtgatgccctaacagttggatgggttccacaggagcagttagccgaatctgatcgccatcaggtggcggaagtggcgccggcaccggcgttaccggaggagcgaggtgctccggctcctacagtggtgccttctagggggaagcattacaggggggttaggcagagaccttgggggaagtttgcggccgaaatacgtgacccggctaagaatggggctcgggtttggctcgggactttcgagacggctgaggatgcggctctggcttatgaccgatccgcttacaggatgaggggatcaagggctctttnnaattttcccctaaggatcaactcgggtgagcccgagccggt

SEQ ID NO: 10103 - DNA, 870 bp, Citrus sinensis
  Predicted polypeptide sequence is orthologous to G1006, G22, G28
caaaaagcaaaaatgatttctcatcttcaccatcatcaatatcatggaagctcaagctccaataaaaatgatggtctcgtgatcagttcttgtttaacagagaactggggagacttgccgttaagagttaacgactccgaggacatgatcatcttcaactacctccatgacgccgtcaactcaggctggtctccgttagattcaacggcaacgtctagcgtaaaagccgagtcagtaagtgataattacaaaaataataataatatcaataatcagaagatgtgtagaggagggaggcactatagaggagtgaggcagaggccatggggtaagttcgcggctgagataagggacccagctaagaatggagctagggtttggcttggaacttacgagacggctgaggaagctgctctggcttatgatcgagccgcttttgatatccgtggctcgaaggctctgcttaattttccccacaggattggctccgacgagcctccgccagtcagagttacggctaagcgaagtcattcggtagactcggcggctgcggctaagaggagaaaagattcagcggcggctaaggagcatcaattgaccatgctgccagctggcgagcacttattggtaaattgagttttcggaaatcaaatgacaattttggtttgtgctgtgtacaaaattgtaacagtggttcaaaagtccagagtaatagtaacactactattccaaaataagaaatagcgaagattgacactttctcctatagtttctggattttgctgtttattttctatggtttttattatactgttgtattttctttttctttttttttttatgtcataatttttaccaaaaaaaaaaaaa

SEQ ID NO: 10104 - DNA, 439 bp, Citrus sinensis
  Predicted polypeptide sequence is orthologous to G1006, G22, G28
gaattcggcacgtggcctcgtgccgaattcggcacgaggtacgcctgaggatgctgcattggcttatgatagagccgctttcaatatgcgcggctcaaaagccaagcttaattttcctcacctcattggctctaatgttgagcctgtgccgctcggcagagttacgaagaagcgtgaatctccggagccctcttctccttcttcttcttcttcttcgtcgtcgtcgtcgtcgttcacagtgcttagttacgattctcccaagcctaagcggagaaattatgggataagtttctgtacatctgatgtgaactgggaaaatgttcaataatatccgcgttattttgcaaaatgtcacttctagaagcaggtttcttggattcatcactttatgtccttgataaatgatatatgacaattactaaaaaaaaaaaaaaaaaaa

SEQ ID NO: 10105 - DNA, 799 bp, Citrus sinensis
  Predicted polypeptide sequence is orthologous to G1033
cggctctgcttttgtgttcttcgcttctcttctatccgtccaggcatatcgcttctgaaaatgaaggttaccaggggcaaaggagcagtcaagaaggacaaaaatgaagtagtgaagcctgttgaggacagagctgcaggaaagcgaaaggctgtgcttaaagctagtaggagtagcaacaagcgcaccaagaatgtcaagtcagcaaagaaagaccctaacaagccgaagaggcctcctagtgctttttttgttttcctagaagagttcagaaaggtttacaaacaagagcatcccaatgttaaagctgtctcagctgtggggaaagctgggggagagaaatggaagtcgctgactgatgcagaaaaagccccatttgaagcaaaagcagcaaaaaggaaattggattatgaaaagctgatgacagcatacaacaagaaacaggaaagtactgaagatgaagatgaagaggagtctgagaagtcaaaatccgaggtgcatgacgacgatgatgatgaagaacttgaagaggaggatgaagaggaggacgacgactagattcaggagcgccactgggtatagttcctttgctttatccagaaaaaatcctggacgttgtatgaccatgcagttgggttattttgtgtttttaactataaaagaattcaactcttcgttctgccaacttgtaatgtaatgctggtactgcattcatctgcagtctgcatatatacctactgttttgagtaatgttttatatatggttacagaattttgtatgtaaaaaaaaaaaaaaaaa

SEQ ID NO: 10106 - DNA, 870 bp, Citrus sinensis
  Predicted polypeptide sequence is orthologous to G1048
tttttttttttttttttagtaaatacgatctaaatattatgaagaaagttccatcacatcacatgccatagttctcaaagatagagctactttgacttatcctataacataaaccattcagtagcattttcgcttctaattatatagaccctttcaccatcctctcatatcctgaaatgaaaaaccaaaacttggagggggggaaggcattctcaagccaaaacactaagcgcatgagaagtcattttcatctttctccttgaagctttgcatctccgagacttcaccactgctaatagataattcttacttcctgcttctctttgaactagatttcctggagccttttcttccacttgaaccaggggtactgactccagatgtgaccagatgggtttgggcagagtgaataggcacatgatgcccaggaaccaaagcagggaacccaacagcagggattccaacaagagcacagcagactcctgcttggtcaaggatgcaccatatgcattgcccttttgcaaactaaatctaagggattgattttctgcaagaacacagtgaagcaaccgcccgagtttcctgcattcactttccaagtacctgctctttatctccagatccttcacatacatcttcttcctctcccttgatctgactgccgcatccctatttctcaactgccttctccgtttcttggagatgggatcatcagcattatcgttgtcagtgtcgttatagtttttgtcgctgttgttgacctctggttcatcgagcaccttctcctcagccgggctagcattaccagattcatcggcaccgttttggtccttgtcagttggcagctcaatcacctcagcaccagaagca

SEQ ID NO: 10107 - DNA, 903 bp, Citrus sinensis
  Predicted polypeptide sequence is orthologous to G1062
acaactctaaatatcataccaattcatagatgcaaccatggatccatgataccattaccctaccaccaataaagccagtaatggcaaatacacctaaagtaaccgaaaaggagattttattctacgagctgaaattacaaaagaacaacacttgagtttctgtgctttctgaggcatgactaagaacacaactgtgaaagatgcttacccaaactaccaattctccaaacatatgatgactgatgacctacaagcatcagtctggtcttgttcgtacctctacaaaatgaaaatgagaaccgaatttcatttacatactacttgaggtacagaagaactacagttagtttcttcactcacaaggtggttgaatgtacagctattcgattttacatcacatcatggaagccagctgtatccaagagcaccgatttgatctgcttgggcaagacatcctggccttccctgcattgctctgctcggaaaacatccagtgcaaacccattgaaacagctgatgacagcctgctgaatgtccaacccaaggctgtccagagccctcatagtagagagcaagagacccggcctacgagcgcagaacatgtgaatgttcacagcccttccttctctaatcctaacttccacccttgcagcttcgcctgttggactccggcttatttcttccttgacgcggcacggaagggtgggtggagttggggtcataggttggatgcttgtagagggctgcatcaaagagccaggtggggttgactccaattcattgtgaagatcattgatcctctgcaggagttcctttaggtaatcaatggcatcccccagtattgaagccctatccatcttgctaatcttgggcacaacagacctaagcatgtaaagcctatca

SEQ ID NO: 10108 - DNA, 801 bp, Citrus sinensis
  Predicted polypeptide sequence is orthologous to G1067, G2156
tttttttttttttttttacatatataataataattaattgagaattaatcataatgataatccacatatagctaattgcgagctagaatggtggctgccttgtagtagtagcagcattattaccagtagtagtaccagtgctgctccaattgcctgcggcaaaaacgtcaccaccaccaccaccaccactaaatggataattaattcccatattcataattcccaaattatgaaaaggccaaggcacgccaccgtctcccaattgtccgccgccacctgtcactcctgaagactgagaggctgccggtggtggcgtagtggagtctgcatcctcctgaagctcaaggggtaacctatcgtagactgcatttgcaaaagaagcggccatcaaaaccacagtacctgaagcagtcaaagggcccaccacgctccctccgacaacttggccctgcccacctgctaaatatatagtcaagccaccagctccggggggtgccggaggtggaagtgaagttccagtgagtgacaaaatctcaaagcggccgtgaagtgttatgttgacagcaccaccagcgctactagcactgctgctgccaccagctccagctggtggttgcctgagtgtgacattagtaacagctccagttccgctgagaatacaaacaccacggccacgacgccttgcataggttgaaacggagtccacaatgtcagcgccagatgatatttcaaggacatgggatctaagtgcattaggggtgtctctagttacgattattggtggcttctgcttgttctttg

SEQ ID NO: 10109 - DNA, 752 bp, Citrus sinensis
  Predicted polypeptide sequence is orthologous to G1078
ttttttttttgaccaaaacaggatatcataaaaccacaaaaaaagaatccacatatttacatatcaactccccctttcccaccaaaaagagaacaaaaactgcaataattataggagcctacaggcaaaaattccaactcttatgaaattcaactttaaaaaattcaagtggaaaaattatggtatatctatttgatagcataggaacgagtgcataccatctcaagtgcttcagtaaataaggtagagaagctggtcaatgcctgaaaaacccctggcaatcctgtctgaagattgttcagtgtatttgctctggtcacctctactgccctggaatgcctcagcaactcatcttccacccgcctttgacaggcggcaagctccaattttttctcagcaagtgggtctcgagcatctaatacatgtccattatcaggcccaggatcaggaagcccaatacctaccatggagtatgaatggtagaatttcctttctatgttacgaagagatgaagccttcttctcaagttcctttgatgcagtttcagttcgctttttaatcttcagctcttcagtttgttttacagatatcacatgaacaacatttatgaagctcttgatggcctcggaagcaactgtgtccggaacacgctcaagagcaagcttccactcatcgaagaaaccatacacctcagaaggttcccttttaccactcatgttgtcattgctgacagggataagggtgagcttgaa

SEQ ID NO: 10110 - DNA, 787 bp, Citrus sinensis
  Predicted polypeptide sequence is orthologous to G1089
atttagatcactgattaaacgataaaatgggctgcacgcaatcgaaaattgagaacgaagaagcagtgacacgatgcaaagaccggaagcagttcatgaaagaagccgtgggggcccgtaacgcttttgctgctgcccactcagcgtatgccatggcactcaaaaacaccggtgctgccctcagtgactacgcacacggcgaggtccagaaccctcagctcgtagccggcgcaccccaccagccttctgcttctgctgcggtggcggcggcgctccagcctccgttagatcctctcctcccgcctcctccgcctccgtcactgaccacttcgccggcgccgattcagcgtgcggctagcatgccggagatgataaagatacagaagactcgagagaatggcgtgggaccgacgattgaagaggagaacgatggtgatgacgaggaagatgagattgagagtaatgagaagttgattatgaggaagagaagtagtgggagaaatcggagcggggatcatcagaagaaagaggaagcaggtgtgcctcaagagcgggcgcggccaacggaggttgagaatagtgagtctatgcagtcgatgggaaattggaattatgattattttttccagacggtggatcactatccgggaccgagtttggaggtgaaagaggaggaggttatggagaataatgagagcaaggtgtttgatgaaattcctaagagaaaagaaaatgtggaggaaaagcggaaggaggtaccaccgccactagtggtggaggacgtggc

SEQ ID NO: 10111 - DNA, 872 bp, Citrus sinensis
  Predicted polypeptide sequence is orthologous to G1134, G2555
cgaattagggtaccgcggcccccccttttttttttgctaacgagactgataataaattattatcgtgtacagcacttttatagccataccaactgaacttcagagagcatgaagttcagttctttgccaaaatgaaaaagtcctgatcatgaacgccatggctatagttccatatgactggcaatcttccaaatatagaggaatagttagtgataaagattgtgccacctgttgttgcgaggctgatctcttggagggtaggaatcataggatattatcgccaaacaaaccatgatggactttaaccttgtatatatagttacaaatttggtaacttctcagattaatcttttgccgagcatttgcatctcctctgatgctctgtgagttcctcaatttgcttttgaagaaacttgacatattctactgcctcctctaacatatcagcggtgtttgtttgcttgtccatgttcggcacaagatcctgaagcttcctaatacggtcactgatccgcgtcctacgaaccctctcggcaatacttcgaggatgagtggcacaaccacgctttgcacgaaccctacaaggcactgaatcctccaaaagtttctccatatccatatcaaccaaatttgaaacaccaccaggtacctgtccactttgctccactttcaagtgagagtgaaagttcagttttgcagttggagatggaaattgtgtattgttgtcttccctagctctcttattggaattaggagaaacatcgacataatcgtaactcgatggagttgcatagtttgaaaagtacccatcaaataaatcggcaggggagctgttctgccgctggaaaccaacttggtccagctgactctga

SEQ ID NO: 10112 - DNA, 733 bp, Citrus sinensis
  Predicted polypeptide sequence is orthologous to G1140
ttttttttttcctttttttaatctcttttccttctcccatattctctcgtctctctctatcgctcattggtggcattttcaaagtctccattccgaagttttaaactctcccacaaaaccaaaccacattaccagccgatctccataagccaaattgggaagatcacagcagtaacagctagcaagcaagggcaaagagatggcgagagaaaagattcagatcaagaaaattgacaacgcaacggcgaggcaagtcactttctctaagagacgaagagggattttcaagaaagctgaagagctttctgttctttgcgatgccgatgttgctctgatcatcttctccgccacaggcaagctcttcgaatattccagctcaagcatgaaggaaatcttagaaaagcaccgtgtgcactcaaagaaccttgagagggtggatcaaccatctgttgagttgcagctgttggagaacaacaactactccatgttgttcaaggaagctgctgaaaaaagccatctgctgaggcaaatgagaggtgaggagatccatggattaagtttagaagaattgcagaagcttgaaaggtctcttgaagttggattgggacgagtgatagaaaagaaggaagaaaagattacaaaggagattaatgaactccaaagaaggggaaagttattgatggaggagaatgagcgattaagacagcaagtggcggaggtatcaaatgcatac

SEQ ID NO: 10113 - DNA, 880 bp, Citrus sinensis
  Predicted polypeptide sequence is orthologous to G1140
tttggtttacaaattaatatccttttagtttggtgatcattcttccagcccacaagcttaaatatgtcggcaattatccagaagtgcttacacaattggaaaagacaaataaaagtaaaaaccaaaaaatagctatcttgtagatgtccacaattaatgcaaacatatacagtacagtacaatcacaaatagcagtgacaccaagccaacgataatcggatcggcgagaatccagaacaagtctcttcttggatatgttccgctttgacaattccataaacacaacagcatctaaaaaatatggcagggttacgactttattcactgtggaattaatcctctttatttgattgtctgcccccagttcagctggagtagggaagccctaatttgagagaagtatcagaactatcatcctcaggaggagggccactgctgcagctgcagacgttgtttacagattctgatgacatgccttcttcttggatagcaatatctgaatccactaaaacaactctttttcccttgcacgaggaggccaccttctgctttagattcttgttctcctccagcagcttagctcccttcctttcaagtgtagagatctcattcataatccggtcaccctttgtctggagcacacggctaagtccctgttcaagcattgtttcaaggtgctggagttcctcaatagtcaatccatgaagatcctctcctctcatctgccttagttgacggctcttatcagcaatttccctgctcaaactgagatacttgctattctccaactgcagttcaagagatggatgattcaatttgctgatgttacttgaatgcatgttgtaccttgcaattatgtccttcatgctggagctggagg

SEQ ID NO: 10114 - DNA, 886 bp, Citrus sinensis
  Predicted polypeptide sequence is orthologous to G1146
attatatctaaattacaaggttggtggccttctttatggtgaagttcccacaggccatttgcccgcaaaacattcgaaatatgcaaacatttggacatataaacaattaaacatgctgaattaatattttggatctttgtaagtaatgcaaaaaaaagtgaggttgggggcagacaatatttacgtcatgtattaatagaaatgaaaacaattattcccaaaaaaagtcacttagttcaacgcacgggcttaagttgaacaagccattttttgttgttacttcatgattgtagtaagctgatggtagtagatcatgctccctgattattcctccatgaactaaacctttctgaggatcttgaatagatttatagagatctcagataatttcctcattgtgtgactgggcagagacaactcctctgtacttgattacttctggccaatacatcgaggccaccacctcggtttagcccagcactttcaacttcattaaactattcacttgagcctttgcagttgttcccgtttcatttgaaaagactgccaccattttgtgcatttctttttccaacttttgatataaattgctcatgaagtcatcttcctctgaatactgtatgacaatgaactgttgcgtccgatcgaacggctcatcaacagatcaaacagactttttccaacccttttccataaattacatttgcctaattcctaaagtttcggctctgcccaatgtcggccgtagttggctgccgcagagatgtattcgacttcaatttctctacagcgatttcaaatttacttcagcctcatacgaccgcactcccattggcaattaatttcattatccgattttactatacgtggaacagatttgagcaat

SEQ ID NO: 10115 - DNA, 830 bp, Citrus sinensis
  Predicted polypeptide sequence is orthologous to G1146
ttttaattttaacattaatataaaataatattatttcattaaattataacttagtacaatataccttaatgcaatacaattaacagtgtaatgcaatagtgtaaaagcacaaagagaacgttcatatcaataatcagatgtttgatggaatacgggaatcccaacaaacaccattgtagaagcatgctcctttaattttacaacaaaagttaaccatgatcagccccatggatccaagccttccattcatcttttgattgcaacctgtttagtaaggtccagtccaagcagcacggcacaaaattcaggtcacaattgcacaattaaaatatcactggcatccattacagacaagtatcgcatgcaatacactggaaggcaaaccatctatggagttctcaaaatagatctaaatcttgacatccttggctcatcagggcaaatgtcgaattcttatctcatggaaaggcaaccctaacagtaaaacataacccgcttgacattctccttcagggcaggaaggggtctgacagcagcaccaactccaggtccacgtgtgctccttgcaccgacccctccacccatgcctccacgtccaatagttccactggtcattgaaccactgtctgatgtctctggctccatatagaaacgagctcggaatgctgcaaggtgggcatagtatgctgggggaacaatggaaacagaacgagtgcacctagcatatgtgtagcagaggttgtttgtgagggactgtagtccatcagctgtaaacttgttctcatcccatagaacatggtaatgggcaggacggcttgtaccctgtattc

SEQ ID NO: 10116 - DNA, 950 bp, Citrus sinensis
  Predicted polypeptide sequence is orthologous to G1146
ttttttttttaaccaggacaatatgcagctaacatttttaaaataaggagaatcagaaacatttttaaaataagaaatgaagttttttggcatttaaatttacaaggcattaaccaggacaatatgcagctaacattttaaaataaggagaatcagtttctacccttgatgtccaatttgaaactactcccaaaataacagtactgtccaaaaagggcaccacgctggtactccatataccaaaacacgtcaagccttgatgaaaaccatgacaaagaggattgatgctggagactactttcagcagtaaaacattacatctttcacattatccttgatgacgggaagaggccggatagccaaactcccctccgccgtgctcctagtccctcctgtggatccacccgcagatgtttcgtcttcgatataaaaacgagcccgaaaagctgctaaatgtgcataatatgcaggaggcactattgaaactgatcgagtacaccttgcatacgtgtaacacaagttatttgttaacacttgcaagccatctgcagtaaaacggttctcatcaaacaatacatggtagtgagttgggcgactggttccctgaattcctgcatggctgttgaggtaaaaatcaaattctgtagggtgacaaatttgagtatcgacaacagttcctggtaaaatatttccactcctatccgtcagatcacgtctgttgtgctcagcaggaaaaaggcgagtatgatgccttttctgtaccacaacaaacgtaactggtggcgcatatccctcctcaagtgaggcacaggccagtcggatagcattcatttcatggagcaaaacctgactgaactgcccttcactaacaccatctcggtagaaaataatactctcaggtttacggttggttgatattttgaaggcaattaacagttccctgatcatcc

SEQ ID NO: 10117 - DNA, 546 bp, Citrus sinensis
  Predicted polypeptide sequence is orthologous to G1198, G1806, G558
tttttttttttttttttcttagaaaaaaaaacttaataactttatctcatcaaacattcaaattcatttgagaaacattggttacaatgacaacagacactggaataacacttacaacttacaagagtcccagagaagataacgattatgcggcgaataataaacagaaatacatatccatttcagagaataatggacaaattctaccagtacgacctattaacagaaaaaccagtaccaacactaaagtataaaaatctaggacataagaaaatctaaacagataaaggggggaaaaattgtcacaactacagaacaattatctttttcaggatgtaattcagattccttccccccccccctctcaaggtgcataatttcacaaatctacctggcaaaaaacacaatgcatcttcactctcttgggcgggccatccagagggaactaagagcacgtagtcgggagaaataatcatggattgcaaggagtgcacgagcagactggcgcgttgtcaatattcggtgcatttgttgtaatgtttcctc

SEQ ID NO: 10118 - DNA, 678 bp, Citrus sinensis
  Predicted polypeptide sequence is orthologous to G1198, G1806, G558
gtggaaaacacctgttgagaggtgtttcatgtggttgggcggatttcgttcatctgaactccttaaggtaatcggtaaccatctggaacctttgacagatcagcagttgatgggcatttgtaacctacagcaatcatctcaacaggctgaagatgccttatcccaaggaatggaagctttacagcaatctcttgtagacacactttcagcttcttctcttggccctactagttctgggaatgttgccgactacatgggccaaatggcacttgcaatgggcaagcttgccacattagaaaattttatccaccaggctgaccttttgaggcagcaaacacttcaacaaatgcatagaattttaactgcccgtcaagccgcccgcgcccttctagtaataaatgactacacttcacgccttcgagcactcagctctctgtggttggctcgtcctagagggtagggactgacaatatcactttcgctggaattcatcagtgcttgtaacagaaaagttctgctatttcacctaaattttggatccattgaaaatgttgggaccataagtggtgaggtgtcatgttagtcactcttggatagcccagatattgttgttacttttgtatttattgctgcgttttaccagatgccagtgttaagaagtaaaaaaaaaaaaaaaaa

SEQ ID NO: 10119 - DNA, 836 bp, Citrus sinensis
  Predicted polypeptide sequence is orthologous to G1198, G1806, G558
gactttttaatggtctgccgatatgttctgtgagatctgtgagatccaaggaaagcatttaaagtcttgctgcaacatcaaagttgcttgttcataattatattggatcaaaatctctgctgcatgagcttaatatactgtgcagcagcatttgatgtagaatattctcgctggcttgaagagcacaacaggcatatagttgagctaagggctgcagtcaattcacatgcaggggacactgaactccgtactatcgttgacaacgttacatcacactttgatgaaattttcaggcttaaaggcattgcttcaaaggctgatgtcttccacatcttgtcaggaatgtggaagacaccagcagaaaggtgttttatgtggattggtgggtttcggtcatctgagctccttaagcttcttgtgaatcagttggagcctttaaccgagcagcagttggtaggcatctataatttgcagcagtcatcccaacaggcagaagatgctctgtcacaagggatggatgcattgcagcaatctctggctgagacattggccaatgggtcacccagcccatcgggaacatctgggaatgttgcaaactacatgggtcaaatggccatggcaatgggaaagctaggaactcttgaagggtttcttcggcaggctgataatctacgtcagcaaactctacaacagatgcatcgtatattgaccacccgacaatcagctcgtgcgttgctcgcaataaatgattacttctctaggcttagagccctcagttctctctggctggcccggccacgggagtgagagacagttcctcttcaaaaagttattct

SEQ ID NO: 10120 - DNA, 906 bp, Citrus sinensis
  Predicted polypeptide sequence is orthologous to G1226
tttttttttttttttttcaaaaggtccctcaattaaacaaataaatcattattatctactttacaataacctaggctaaagagtacgtagcaagtagaaaagaaggtacaaaagtaaaaaaaaaataaaaaataaaaaagagagaaagagagagagacacacacacacagagatgtctaatgatgaagcaccaacaacatcgtttgtatatacagacagacgcaaccccaaagtcaaaatgaaaagagaagcatcattcagtatatgtaatcatgaaaaattagatattcaaaactcgatccttcttcagccaggcacgtgtggtcccacttcccaatctcatctcttcacatgcacccactcaaaatccaaaaatccttcagaaaaagaacaataataataactaactgaattacatattctaataattaaaaaacacaaaaaggaacttttttaggttaacaagtaaacatcatgtggtctggcctgcgccctgcagctagccctctctggcacagccacacagctcgaagctcaagctgggctgccctctatctgttgccccaccaccaccatttactcaatttttattcttttttctgtaatttgatttttttttttcctcttccacttagtttcttctttctaacctagtcctccctaagcaattaaagtcagctgtacgtcttcaatcagtagaccagtcagctaccgttgatgtagctaaatatttgatgaactgctgctgctatctcttccgctgaccctagcttacagtcttcctcgatcttgagattgaaggagtaatgaactgtagtttctgaggaagtaatattgaggtgcaaaaaagtaagcctcagatcttcaagtgctacaatggctttcaacaactgaccaggccttctc

SEQ ID NO: 10121 - DNA, 735 bp, Citrus sinensis
  Predicted polypeptide sequence is orthologous to G1266
tttttttttttttttaacgaaaacaagaaattttgtattaaaaggagaaaaaaaaaaaaacaaatcacctaaaccccactactagagcactatgataattgacaccctaaaaaaaaaaaaattaataataataaaggaatcaggtggttgataatgaacgatgatgtttgatcaccaaatagtagcagtagcagctccacatgagctcatcaaaagttgctctagataatcagctcccaaatcttcaaacaccaccacattttgcgataattgtgaccctacagctacagctagttgatggtgatcgcgatcttgattattcattttgattttcttgttactcaccgaagatgatgatgaagatttggacttctttctgatagagtgtcgtttcttgagagccacaaccggcgagcacccatcttcgcggtggtacttcatttcttgaagagattctctgaccatatctgcaggaaaattgagggtagccagggaaccccgcattgagaatgcagcttgatcgtaggctaaagcagctgcctcagcgctgtcgaatgtgcctagccaaactctaaccccgtttctcgtggagtcccttatctccgccgcaaatttcccccacggccgcctcctcacgcctctgtatgacttgtctgatgatgtcttgcccgatgatccctcctcctccgccgctttgccgccaccataattacttgaagttgaagaagtcacttc

SEQ ID NO: 10122 - DNA, 866 bp, Citrus sinensis
  Predicted polypeptide sequence is orthologous to G1266
ctttaacttcatattaaataaaagaaactagatacacgaatcaccccgaattgctttcaaaaaatggaagcttgtacaggcataaaccgtctttggtttacatattgaaaaagaagataacgacaataactaaataaaaaaagataaagggcaagaagattaagataaggccagaaagttacaagtagttgacttattatctaattcaccaattagcgaggtcttgctgtagtagtagtagtactttcagatgaacttagcagctcttccaagtaatctgctcctaaatcttccaacaccacaaaattttcaatcctcaaattatctctctctttatgcttcttattattagtcaccatttttcttctcatagaatgtttcctcttgagtgcaaccacaggtgagcatccctcctcggtgttacacttcatgtctttaagtgattcttgaaccctttcaacaggaaaattgagtattgctgaagagcccctcattgagaaagcagcttgatcgtaagccaaagcagctgcttcagcactatcgaatgtccctagccaaaccctaatcccatgcctagttgaatcccttatttctgctgcaaatttcccccacggccgccgtcgaacgcctctatatgacttttccttggtggggttttcctctgttgttgaactcacctcttcttctttaattctcttggagcttactagtgcttctgatgttgcttccggtgtggcttctgctattagtccatagagaagcatttcttctgagtcattttcattgaatggaagataattgttataaaaagggaaagactccggtgacccgaaagaggattccgatgaggaaattgaatttggaga

SEQ ID NO: 10123 - DNA, 772 bp, Citrus sinensis
  Predicted polypeptide sequence is orthologous to G1272
tagggtactggatattatattacggcagcatgctgcaaaacagggctgtctcctagttcgccaatcgttctttcacaatgatccaaaaaattttgctgatgtcggagggggagttcttggctgcagaggattccattcaagttttaggaccactcagggaggcttgtctttgaatattgatgtatcaactaccatgataattcagccgggtccagtagttgattttctaattgccaaccaaaatgttagagatcccttttcaattgactgggccaaggctaaacggacactaaaaaatctgaggattaagacgattacctccaatcaagagtacaagataactggactgagtgagaaactatgtaaagagcaaatgttttcactgaagcagaagaatgttaaggatgatgatggtgaagtgcaggaactggaaattactgtttacgactattttgttaataatcgcaatatagatttgcgatattctggagatctaccatgcatcaatgttggtaaaccaaagcggccgacctatattcctcttgagctttgtgaattggtgtccttacaacgttacacgaaagccctgaccaatctacagagagcatcactagtggagaagtcaaggcagaagccacaagaaaggatgagtgttttgtctaatgctctgaaacttagcaaatatgataatgagccaatgctgcgttcatgtggcatttctatcagtactaactttgctcaagtggaaggtcgtgtgctaccagctcctcgg

SEQ ID NO: 10124 - DNA, 805 bp, Citrus sinensis
  Predicted polypeptide sequence is orthologous to G1272
ctttttttttttttttacttaaacatgccaatcattccaatttccgatacccgaatgcctgaatccatcaaaataacagtttaacagcccatcgctgtctggggaaatagagagactggcgaatgcatgggactggcaagagtcaacaacaccagtaatcaccacaaaaacaaaggcacagggcactttcggtttctagacctaaaattaaatagcagagattttcaaggcatcactacaagttctagacacctttgccactggatggtccagatgaaaaccaaaaggctaactatatacaaactactttgataggattctgattgacggtagaagccacacaagtgtctcaacagaagaacattgaattgcacactttctcctgcagtctaggcagctgggggacaggaacaggtccagcagatgtcatcccaccctggctagaagatgtctctgataagtcttcgaacttcatgaatgatcctacctggcttgctgccaagtgggcatagcaaattggagcaactacagaaatggctgtagtgcttctctggtacacataagaaagtgagtgcactagttcctgcagctcatcacttgaaaagccaatttcatcaaatagaacgtggtaatgtgttggccttgaagtaccaatcattccagcatgggcacaaaggtagaagtcatagtttcttggatgacagactttgttgtcaacaacagttcctgcataaacaaaaaattctcgaaagttatgtctaatgccgtaatagacttgtgctgtacaaaattatgaaaaggctca

SEQ ID NO: 10125 - DNA, 803 bp, Citrus sinensis
  Predicted polypeptide sequence is orthologous to G1324, G2893
cggtaagactcgaaaaaggagtctttgttaatgttagaacccatatgtcttcttttagtaagagctcaacttcatctatttatggcgaaaatgattctgatcagctgaggagagggccgtggacacttgaagaagacactctactcattcagtacatatctcggcacagcgaaggccgatggaatttgctagcaaaacgttcgggcttgaagagaactgggaaaagttgcagattgagatggctaaattatctgaaacctgatgtgaagagaggcaatctcactccacaagaacaaatgtcaattcttgaactccattctaagtggggtaataggtggtcgaagattgctcagcacttaccaggaaggactgacaatgaaatcaagaactattggagaactcgtgttcagaaacaagcacggcatctaaagatagacgcaaatagcacgacatttcaagagattattcgatgtttttggatgccaagattgcttcaaaagatggacacatcatcatcatcatcaccatcagctttatctcagaatcctacaattaattctcagccgtttgatcatgcttttcatcatcagggatcagcatcggcacaaataatatcccatcaagttccttacgatcggggagtgattgatcatcaagaattgaattcatcatcagactcggagcacggcattggcaccagcacttcctgcatttcttcatccgaatcaatgaatttttcccaaatgtctcagttttcggagtacccaaccggtggcgaccattttcatgctagtaataatgat

SEQ ID NO: 10126 - DNA, 784 bp, Citrus sinensis
  Predicted polypeptide sequence is orthologous to G1364, G481, G482, G485
tttttttttttttgttcatgcaatcatctattaaataaagaccctaatttacagcactaatcatcggactaccacagttgttttgttgataagggcacgtaaaagacaaagtgaagggaaaaaaatccgaaccaccatcaccctcaacaacaaacataaaaggaaaaaaatctgaaaaaatatagaacttcagatcaagcagataagttaatatcaaagatgctataggtgttgaaactaaacaatttgagcaaccctaaaatcataaaatatgtgacagtgaagctagaaaccacttattcatttccctgcatggatggaacgatcatatgctgcccctgtgcttggggattaacatagttgagtggaccctgaagagcatactgtgcattttggccaggcagagctccgatcgtgtcccttttagcagatccatccccacccctagcagatcctttggtgtcaccctccatctccctgtacctcataaggtatgccttaagaggatcaatataatcttcaaaacccagagttgccattgcccagagcaaatcatccccattaattgtcttcctcttctccttctgacacttatcactcgcctcgctggtaatgaagctgatgaactcagagacacattcctgtacagtatccttagcatccttagcgatcttgccattagcaggcaaagccttcttcatgatcctgctaatgttagctattggcaaatacctgtcctgctctctcactcccccagcgtgcgggctctgctctcccccgctct

SEQ ID NO: 10127 - DNA, 885 bp, Citrus sinensis
  Predicted polypeptide sequence is orthologous to G1364, G481, G482, G485
tttttttgcacataactaaaaatccctttcatatatcatacaacaacaacaattacatcaagaggctatgaatggaacatagtcactgtgaatctcactcccctcaattagtacttaactatatatatatatatatatataaattctttacccaaaactcacataaataaacataggaaaaaaaagaattacctaatcatgttcatatatgataatatgatataacaatttaaggtctatctaaattaagctatataagtcccagaagctgatgctccaaaatagacctaccttgacctaatagctccactgctgccaccgccgcctctggcggaggcagcagctgacgcagcgggggacccactctttccagcacccatctgatgatgctgatgaaatccaccagagccataaacgtgtccttgatgtcccatcatcatcatcccaccgtacatccctccattgtaacccccaccagcaccgccaccaccactggccccaccaccagccgctgctccgccaccggctgacccagcgccgcctccgctaccaccgccgtccttctccctacccatggaagtcttctctccctccatctccctatacttttgcaaatagaccttcaagggctccacgtactcttcgaagcctaaagtcgtcatggcccacaacaaatcatcaccgttgatcgtcttccgcttctcgcgctgacacttgtcagaagcttcgccggttatgaaacttataaactccgacacacactcttgcactgtctctttagcgtcctttgatatcttcgcattcgctggcaaagccttcttcattatcctgcttacattggctatcggcaagaaactgtcctgttctctcgccgacagctcgctg

SEQ ID NO: 10128 - DNA, 717 bp, Citrus sinensis
  Predicted polypeptide sequence is orthologous to G137, G145
ttttttttttttttaaaaaaaaaagggggaaagaaagaaagtgtagctaggtgagaggaaaatagaggatatgggaagagggagggttgagttgaagagaatagagaacaagataaacaggcaagtgacgtttgctaagagaagaaatgggttgttgaagaaagcttatgagctttctgttctctgtgatgctgaggtggctctcatcatcttctctaatcgtggcaagctctacgagttttgtagcagctctagcatgctcaagacccttgaaaggtaccagaaatgcagctacggtgcagtggaagtcaataagccagcaaaggagctcgagagcagctaccgggagtacttgaaactgaaaacaggatttgagtccgtgcagcgaactcagaggaatcttcttggagaggatttggggcctctcaactcaaaggaactggagcagcttgagcgtcagctagagtcatccttgaagcatgttcgctccaccaagacacagtatatgcttgatcagctttctgatcttcaaaacaaggaacaattgttactagatactaacagagctttgacaataaagttggatgaaatcaatgcaaagactcagcttcgaccttcttgggaaggcggtgagcagcaactaggttataatcctcagcatgctcaaactcaaggactattccagcctattgaatgcaatcctactttgcaaattgg

SEQ ID NO: 10129 - DNA, 935 bp, Citrus sinensis
  Predicted polypeptide sequence is orthologous to G137, G145
ggggggtatctgatgaaaccaaaccaattagcaaaattaaaggtacccaactcaggtcaagtcaattcgatctctccttttaggagtgttctatactaaatcttaaacctagctatcaaagcaacctgatcccagcttcttgccctaaacaacaagatctgcagaaacaaaatctactaatttataatttattttttagcctaaagaaacccaaaaaaaacaaaaaatcatccagctatccagcacttgtaagtatattaataatgggaaggggaaagtagagctgaagaggatagagaacaaaataaatcgacaggtgacttttgcaaagagaaggaatggattgttaaagaaagcttatgagctctcagttttgtgtgatgctgaggttgctcttatcatcttctctagccgcgggaagctctatgaattctgcagcagccctagtatgcacaagacacttgagaagtatgaaaggtgtagttatggaacactgcaagcaaatcatcaatcagccaaagagacgcagcaggccagctacgaggaatacataaaactcaaagagaaacatgaggccctacagcacttgcaaagacaattttttggggaagatttgggacgcttaggcttagaggagttggagcagcttgagagatagctgggcagttcattgggccaagtaaggtcactcaagacccggaatcagctggataagctttctgaacttcaaaggaaggaagaaatgttgctggaagccaataacattttaagtatgaagttggaggaaattaatgcagctcggagatcacatccatgggcagctgaggaacaaaacattacatacagcaaccaacctgctcattcggagggttcttttggccatttacacagcaatggtacattgcacttcggtcacaatcctggagtaacagctc

SEQ ID NO: 10130 - DNA, 859 bp, Citrus sinensis
  Predicted polypeptide sequence is orthologous to G137, G145
cttatcattttctctaaccgtggcaagctctatgagttctgtagcagccctagcattatgaaaacgcttgaacgatatcatcggtgcagttttggtgcacacgaagccaaccggcctcccattgaaactcagagcacctaccaggaatatttgaggttgaaaacagcagttgagctcctacagcgatctcagaggaaccttcttggagaagatttggatccgctcagcacaaaggagcttgagcagcttgagcatcaactagagacatccttgaagcatgttaggtcaacaaagactcaatgtatggttgatcagctttccgatcttcaaaaaagagaacaagtgctacttgaacttaacaaaggcctgaggaagaagttggacgaaagcaatattgctcatcaagttcctcctcatcgactagcatgggaagcagcatcagcagggcaaaacataacatacaatcgctacccagttcaatcagaagggttctttcagcctctatcgggaggcaatcccattttgcaaattgggtacaatcctatgggttcggaggaggcacatattccagtccatgcacaaaatgtcaccggattcatccctggttggatgctttgattataattggataataaaatgagttcacatgagcttaatcattggaattctaattaatttccttgttgatggttgtgatttgatctgttttgctttatgtaacctgcaattattatttgctgcaaacagtaataagtattgtttgtaagttgtaacttgtaatgtttgaaaatgacggaatgctcttttgttgttgtatggcttgtatttatatgaacaactgctatctcgaacaaaaaaa

SEQ ID NO: 10131 - DNA, 818 bp, Citrus sinensis
  Predicted polypeptide sequence is orthologous to G1382
tacaatttcttacaattccatttcagaacttgctttacacaatattgttttcttttaagaaaatatgactcataccagtttcacatttgtacaaagcattcaactataagaaattaatacaaacggcagttagaataaggcaattggtgtgtggtagcaacacataacaacaccactactagtgtcagggaactatcatatatagaacaattttccgatatggattacagcctctctttccttaccagccaaaaagaagaaagcaaaataaaccatggagattttatttcggctatgtataatcaaattcatggacctgttagtattcttccaatattttgaggatacgggtaagaagaatgatttaacggtggaaagtcaacgccacgtccttcagttggattccctctagatccatactgattcatgccaccatttacaacaccagaataagctgtgaccgcgtttgcttgaatgattttataactggaactgctagcatggggatggctatgggcaagttcagaatgcagtgcctgtggctgctcatttgatctattttcagtggcagaacttattcctacgccaagatccaggctaattgcctcgccttcttctgatataatcctgcatggtccattcccagctgatggtccagctgcatcatggctactagtccttgcagtaggtacatcatggttatgcttgccctcatatgtggttataactgcttttggatcatgtgatgctctctccacgtgttttctaacaggacatccagcatttgtgcacttgtaataactcctgcttccctttca

SEQ ID NO: 10132 - DNA, 804 bp, Citrus sinensis
  Predicted polypeptide sequence is orthologous to G140, G146
gggggatatttttttcttttttcttttttgtctttttcaggtgtagctcaagcaagttaccagcaaccatggagtttccaaaacaaaacccagaaagctcaagccaaagcaagaaaataggaagaggcaaaattgagataaagcggatcgagaacacaacaaacagacaagtcaccttctgtaaacgccgcaatggattgttgaagaaagcttatgaactgtctgtcttgtgtgatgctgaagttgctctcatcgtcttctctagccgtggccgcctctatgaatatgctaacaacagtgtcagagcaacaattgacaggtacaagaaagcatgtgccgattcttctaacccaggatctattactgaagctaacactcagttttaccagcaagaagccacaaaactacgaagacaaatccgggagattcagaatttgaacaggcacattctgggtgaggccctcagcactttaaactttaaggagctcaagaaccttgaggcaagacttgagaagggaatcggcagagtcagatccaagaagaacgaaatgttattagctgaaatcgagttcatggagaagagggaaattcagcttcaaaatgataacatgtacctgagagcaaggatatctgaaaatgagagagcacaacaagaacggcaatcagaaagcatgatgcagcaaggaggagggcatgtgtacgagcccgcggcctcacagccctatgaccgaaacttccttcctgtaaacctcttggaacccaatcaccagtacgctcgccaagacgatcagccccctcttcaac

SEQ ID NO: 10133 - DNA, 847 bp, Citrus sinensis
  Predicted polypeptide sequence is orthologous to G140, G146
tttttttttttttttactaatcattaatatcatattcgaaattaacatcaaatgcagagactttgtgtttgcattaggcatacagaatatgaattcatggctgacaaacatatatataatatttatgagtcttaaaatagtttatatagctactagcttaggcccctgatgatcacttaattaagcaaagttgatttcttcgctgcatcttatagcaattttgagcgcgcacctgcacaccttttatctagaatgaagtaatagctagataccctccataggatatgacatggcagaatattcttcaaacatattaaactaactgaagggccatctgatcctggcgtgggtaatgattggtgggctgtaatgcattgacttggaaatagctccgggaatcaaatggctgagactgtataatctcgtagctactccctccttgcatcaaattcatgttctgctgtcctctttcattctcggctatctttgctcggagaagctggttgctgttgtgcaagtcaacttccctcttctgcatgtactcaatttctgcaaacagcagctcattctttttagatcggattctgctaatacctttctctaaacgagtctccatgttcttgagttccttgaaatttaacccacttagtgattcacccaacatgtttctgtttgaattttgcatattgctaatttgtatcctcagcttggcagcttcttgctggtagaactgagcatttgcttcacagatagacccagtatttgaggtatctgcagtggccttcttgtacctgtcaattgttgatttcacactgttgttggaatactcataaaggcggccgcggct

SEQ ID NO: 10134 - DNA, 933 bp, Citrus sinensis
  Predicted polypeptide sequence is orthologous to G140, G146
ctttggttttctatttttcttcgggattctaaattttccgaaagctgaattggccggactgtggccaaaaaactcaggtccaatggggagaggaaagattgagatcaaaaggatcgaaaacacaacgaatcgtcaagtgaccttctgcaagaggagaaatggactcttgaagaaagcttatgaactttctgttctttgtgatgctgaagttgccctcattgtcttctccagccgcggccgcctctacgagtactccaacagcaacagcataaggtcaacaattgataggtacaagaaggcatgttcagataattcaaattccggcactgttactgagatcaatgctcagtactatcagcaggagtcagcaaagctgcggcagcaaattcaaatgttacagaattctaacaggcatttgatgggtgattctctgagttctttaactgtaaaagagcttaagcaactggagaacaggcttgagcgaggcatcactaggatcaggtccaagaagcatgaaatgctgctagctgaaattgagttcttgcagaaaagggagattgagctggaaaatgaaagtgtgtgtctccgatcaaagatagcagaaatggagaggtttcagcaagcaaacatggtgactgggcaagagctgaatgcaatccacgcattagcttcacggaatttcttcagccctgctatcatcgagggtggtgtcactgcttactctcacccggacaagaagatactccatctcgggtaagctagatactggagatcaagttgtggcatctcaacaaaagatctacgatcaaactatcattatctactgaatgtgtgtgctacttgatactatttttgaaaccagcgatatatgaaactggatgaatttgtctgtaacctaattacttacgctgaattatcactggcttcctctct

SEQ ID NO: 10135 - DNA, 863 bp, Citrus sinensis
  misc_feature (835)..(839): n is a, c, g, or t
  Predicted polypeptide sequence is orthologous to G1419, G43
ggggccactcaagcttctccacttcctgtttactccaattgtacaactaatattttttgaaatggcagctggtcatcattatcaccaagatcatgaagctttaaccttagagcgcataagccagtacctcctcaatgacttaacaccgatggatagctatagcttcatctccaacctcccgcagcaaaaccctgcttccactgatgaagaaattttagtacaaaagacatcaagcactctaagtcaacgcaagccttcttctataaacgtcagaatacctcctccaactactagcatcttcaagttgaaagatgaagataaagatttcgaggttactgacgattacaaggaaaggcattacaggggagtgaggagacggccgtggggaaaatatgcagctgaaattcgtgacccgaataaaaaggggacccgggtttggcttggaacatttaatactgccgttgaagctgcgaaagcttatgacaacgctgcctttaagatgcgtggaagaaaagccatactgaattttcctcttgaaattggtgagatcagtttggactctgatgaagtgcagcaagttgattgtgggaaaaagaggaaatatgaggaaaacgaggagtttgagagaaaagtgaccgtgaagaaggaggaaacggtgagtggtggtgttggtcttggacctttgacgccgtcaagttggaccgggttttgggatgatggaaatgggatatttagtgtgccgccgttatctccttgctttggccagttgggcgtttgctaaatttggaaattttttatggcagaacagtctttgatgacgtggaagtgaaattannnnnttgttaaaataacttaaccagcga

SEQ ID NO: 10136 - DNA, 819 bp, Citrus sinensis
  misc_feature (11)..(13): n is a, c, g, or t
  misc_feature (33)..(35): n is a, c, g, or t
  Predicted polypeptide sequence is orthologous to G1419, G43
gcggggagcannntcaaaactctttaatatttnnnagattcaaaaactctataagggacacagcttgcttagttgccatggctacaccaattgaaaaatcagcgctcgagtttatcgagcaacatttgttcggcgaaaattctcctattgcgggatttagttcgagtttgtcgagcgacacttgctcgcaatcgcaaacgtccagctctgcatcttcagatcgtagtttcttcaacgatgccgttttcttcgactatgaatccaaacctcaaatcattgatcttgttacaccgcaacccactaatacttgctctgaattgactaacgatttctttgaatttgacattagacctcaaatccaatcgcaaccgagcaattgtagctcggaattcgaacccaagcctaaaatatcaccaaattcatcctctcaatcgtctcgcaaaccgtcgctgaaaatctcagtgcctaagaaagccgaaggtcatcatttcaccaaccggaaaagcaaggccaaacctgagagttcggaagaaaagcattacagaggagttcgacggaggccgtggggaaagtacgcggccgagatccgagatcctacccggagaggcgtacgtgtctggctggggacatttgacacggccactgaagcagctagggcgtacgaccgtgccgctttccagctgcgcggctcgaaagcgatcctcaactttcctcttgaagccggcaagtgcgactcaaacgctgcggtggctagagagtgtgactcgagcgccgaggctggcgcttgtgaaacgaaacggaagagggactgtgagagcg

SEQ ID NO: 10137 - DNA, 671 bp, Citrus sinensis
  Predicted polypeptide sequence is orthologous to G1451
tttttttttttcttttaaaaataaacttccagacggccgaacacaattgcattaagaattcaggtaccattatgctcaacattttaagaggtaagaagaaacgagggggtgggggctggcgagcaaagagaaaagaatatatataacagcaaaatttcctaaacccatataataaggggcaaggaatacattcaaggtggtactaaaagccgaaaacaatctaatgaatgttgcagcagcacagtggtaacaactggtttgttggcactgttaggcataaagaaaacccataaacagctccaaaaacttgataccgacccgcttgccgccagtaaaccaaaatgtaagatgcataaagtgcgaagaagtttccaccatatggttgcttctttattgttatgatgtctgctataagcacctgcccttcattctggtccactcttattaaatattagggaaaaagaatctctgaacagaaagccgcaaataaattacactcaaaaagaaggaactctcatctcctgggccaaaatttctacctatcaaagagctctcaacgagaaatgccgacgcctctcaagcttcaaccaacgggtattatcactgtttatggggttcaaaaaccgctctgcttccacttcagaatgaagcgaggactgcagcctctttaa

SEQ ID NO: 10138 - DNA, 400 bp, Citrus sinensis
  Predicted polypeptide sequence is orthologous to G1451
tttttttttttttttttaacaaaaactttaatactataacttaaaaacaacaattggtcaaccccaatcccgcatccttaaaaaaaaaactaaacccctaacgaaattttgattttttattcctatgtttccccaaacaaaccccctcaaattacccaattgcccttggcaacaatgggccgttgattaaaaccagccatcactgggtcactgcccctcaagtcaatttgaaacaaaaatttttgggataaccctacaactcaggactcatgattcaactgatgcccccctgggtggaacatacaaaacttttgcataaaaattttggaaggggataatccccgtccctgaaacatctttcccgtaaaaaaaaaacccccaaaaaaaaacaagcataaaa

SEQ ID NO: 10139 - DNA, 613 bp, Citrus sinensis
  misc_feature (579)..(579): n is a, c, g, or t
  Predicted polypeptide sequence is orthologous to G1474
aattcggcacgaggtgttattccttctttatcttctccaattgcgcaagagcaacaacacaagagatcccctatttcttcccctaaatcttgttcaaattcggtggctgacaagaataattccacaattgtaaaatcagcgtgtagggttaaggcagattatgttaaaacagatttgtctgtgagcttgaatttggttgttcgacgaacacgcccaactttatctactggcaaggaggcagctgttggatgcaagagaaggagaactgaagcatcatcactacctttcttcctcaagccatgttcatttgatcatgataaagatcatcttcaatcagaagaacacaaaatacttaaccctagctcaattgaggacttggatcttgagctcaggcttggtgacccgccgcctaaggtaaagtaatatatagaaataagagtgcctcataatagtttccgttcatttgtgctttccttttcgtatttcttctttgatcctgaggttacagagcctcatgctttcacatatatcaatttggtctctccagtcatgaatttcaagcgtgcaaaaataacacanagttcctttttcagccaaaaaaaaaaaaaaaaaa

SEQ ID NO: 10140 - DNA, 546 bp, Citrus sinensis
  misc_feature (13)..(16): n is a, c, g, or t
  misc_feature (36)..(38): n is a, c, g, or t
  misc_feature (546)..(546): n is a, c, g, or t
  Predicted polypeptide sequence is orthologous to G1478
ggggtatcaaagnnnnaccaacttatcatctgtgtnnnatttgagtttgctacaaaatgtgccgaggaattcaagaggcaaaccaagttgttggttcctgcagcttcaaaggaagtgcttcttctaatgcaaacactgttgattttatgtcttgtgagctctgcggttctagggcttcattgtattgccatgctgatgatgcatatctatgtagaatatgtgacaaatgggtgcacgaagctaatttcttagcacttaggcacgttaggtgctttctctgtaacacatgtcaaaaccttacgcatcggtatctcatcggagctacggctgaggtcttgcttcccacaatggagagtttgatagagaaaagaaggcagtgtgattccaaggttgaaaaacagtgctcaagaaatctcaaaatgcctttttagtttatttgatcttcttttccattttgggtatgtaatttctctgtgatagggttgtaaagatggagaccaagttttattatttcacgaggaaaaaaatgggagataagggcagttn

SEQ ID NO: 10141 - DNA, 878 bp, Citrus sinensis
  Predicted polypeptide sequence is orthologous to G148
tatacgacaagtatgtagagtatcttggcaaaatattacaaaccccagttagtacaaaagccattagaaaaaattatataatcatcacgtatgcttaattacatatatctcaatgctctactcaaaggacccatccttggatgaagttggtctcaccaaccgtattctttggcactgaagacccttcagatggaagataattcaggtacccaatttgtagagcaggttccgggtcacagttcatgggactgtcatgagaaggatgaacagagaagttgctatttccagcacctgcagcagcagaattccacaggtcttgaatggccttaaaactttgcccttcagtctccagcttaatcctgagctgcttgttgatatctccaagctgacgctcctttttgcggaggtcttccacctgctctatcataatctgtgtcttcctttgcctggccagtgctagggctccttcaagctgtttctcaagattctgcagctcctttacactcagcggtccaagatcctctccaagcaaatgcctttgagtgcgttgaagagactcatattttgctttcaactttgttgcctcctggtaccagctctgtgtttcacgttcgatgctgttgtcttgaggattgaagcagcaacgttggtatcgctcaagggttttgtttatgccagcactaccaaactcatagagcttgccacggctagagaagatgataagagcaacttcagcatcacaaagcacagaaagctcataagctttcttcagcaaaccatttcttctctttgagaaagtgacctgtctgttaatcttgttctctatcctcttcagctccactcttcctctccccataatttttcagtacactcacttt

SEQ ID NO: 10142 - DNA, 885 bp, Citrus sinensis
  misc_feature (31)..(33): n is a, c, g, or t
  Predicted polypeptide sequence is orthologous to G1480
gggactccggagaccaaaactcaaagaaagnnngaaagaggctttatttagtaatgcccatgggaattgaattacatagcgtgaaggttatttccggcgggtggagcgtggcggcgaagccatgcgacacttgcaaagcggcggcggcggctgttttctgcagagttgactctgctttcctatgcctgaactgcgatttaagaatccacaattgcatgaacaaacacgcgcgtgtctggatgtgcgaggtctgcgagcaggcccctgcggctgtcacgtgtaaggctgatgcggctgccttgtgtgtcacgtgcgacaatgatatccactctgccaaccctttagcccggcgccatgaacgcctccctattgagccgttcttcgactcggctgactcgattgtcaagtcgtcggcttttaacttcctggttccgagtgatcaaaatggcggctcagagtttactggcgccagtgaacacgacggcgtggactctgcttcctggctgattccgaattcgaaacctggaattgaaaacgcgggtgaaatgaaatccggggatatgtttttcatcgatccgtttattgatttgaatgattttgattatccgaattcatttcagaatcatcatagcgctggcatggacagtgttgtgcctgttcaaacaactaaaccggaaccaattccagctcaagctgcagctccaattcctttgatcaacaatgaaaattgcttcgatatcgatttctgtagatccaagctctcttcattcaactaccaaagccaaagtgtttcatcgtcatctcttgatgttggagtagttccagatgggaactcgatgtccgatatttcgtacacatttggccgaaatatgagcactgggtccg

SEQ ID NO: 10143 - DNA, 858 bp, Citrus sinensis
  Predicted polypeptide sequence is orthologous to G1480
caaaatccacgcggccaacaagctggcgtcgcgccacgcgcgtgtctgggtttgcgaggtgtgtgagcaggcgccggcccacgtcacgtgcaaggcagacgctgcggcgctctgcgtcacgtgcgaccgcgacatccattccgccaacccactggcccggcgccacgagcgagtccccgtgacacccttctacgactcagtcgactcctctgccgtcaagcaaggcaacggcggagtagtcaacttcttagacgaagaccgctacttggaccacgtcgacgggagaagcggtgacgtcagcagggaggaagcagaggcggcttcgtggctgctgccgatcccgaaggtggcggatttgaacacgggtcaggcgcaggagccgtatgtgttcccggatatggatccgtatttggatttagattacgggcatgtggatacgaagctagaagcccaggagcaaaacagttcgggcactgacggtgttgttcccgtacaaatcagaaacgttaacgctaacggccatttggtcaacgatgcatgctttgacctcgattttccaggctccaaatcttacggttatggctacaactctcactcgcagtgcctcagtcagagtgtgtcgtcgtcatcgttggaggtgggagtggtgccagatggaagtagtgcgatgacggacataacgaatccgtacggcaaaggagtgggggtggaggcagggaatcagacggtggtgcagatttcggcagcggatagggaggcgagggtgttgaggtacagagagaagaggaagaatcgaaagttcgagaagacgatacggtacgcttcgaggaaagcgtatgcggagatgaggccgaggat

SEQ ID NO: 10144 - DNA, 326 bp, Citrus sinensis
  Predicted polypeptide sequence is orthologous to G1480
tttagttagtgcacacatttttttatactccaaaatgagaaacgttgaattagtacctctcttcgtcactgttgccgctggtgtcgttctcgctggatacgctggaatgagaaacttgactggacacaacgatattgtcattaacaagggacaaccttaccaataccaatccaaggaatccccaaagtggagagacagagaaactaacctcaagaactacaagaacaactatcacccagaagaaaccaagctctaaactgtgtgatatttcatgtacaatgttaaataataaaagttcctaaagaataaaaaaaaaaaaaaaaaaa

SEQ ID NO: 10145 - DNA, 891 bp, Citrus sinensis
  Predicted polypeptide sequence is orthologous to G1510
ctcgagaaaggaaccacagacaagttattctttctcctatgttaccgcctatttcgataagatagggatggacaagctctgagagagagctataccaaaccaattgtatggatttcgtaatccatgtcccacgcctcctcactcgggagtagggtagggaaagctcaaagccagtgagtctacggtaggcagggaggagggtggttcaatcaaaggcagtgaaaaggggttgacctgacttcggttatcgagataagaaaaggaatagcgcgctgtagtttaggtaggattcgccgacggaggatgagcgacctgggagtggatggacgatgctagtgttctttatggtgtagttgcgtcaaggcgccaagagcaaacggaggtcactacacgtgctaagactaaacttaaaagaaagtgggcactcgtttcgttggttcaactcctctctcaaggagaagcgaattagcacctactcgaacggttcactctcggtcaaagaaatgctttaaggaaagctgaagtctaaacaggtaatccaattgaattgatagcgagccaggaaagtaagaaatagtacgttgtacgttggtaggaatttagaatcgggataggagtaagctcacttcagtagatagagagttgctcgtcgtcacgaagtatctcataataggcaatgtcgcttaaaaagaaagagctgttcgaacccgttcgtgggtcagttcactttcgcttcctcttcccggtcgaatggtcgagtcagcttgattagtgccagtgctaatgcaagaaagcgctttgcttcaagtgaactacctgtctttgaatcatgcttcgaaactccaactagcgtactataatatggggaaatctaagattgacgtaaaatag

SEQ ID NO: 10146 - DNA, 866 bp, Citrus sinensis
  misc_feature (4)..(4): n is a, c, g, or t
  misc_feature (36)..(40): n is a, c, g, or t
  Predicted polypeptide sequence is orthologous to G1538
gggngaacacttctcgagctggagacacattaccannnnnatatatatatattcacacacacacacacacatatttgagagagatttatgatcagagaaatgatcataacaaacacgaatcatcaagttgaagataacaaaagtaatatggtcttgctttcccagttttacccttctgatgttctcacaccaactggaatcgttccacaacaaggggagccgtctaagccgaagcgcaggcaacgcaaacggaatactaacggaaacggtggctttcgtgctttgaagaagagaaagctgacggctgaacaagctgagcttcttgagatgtattttggcaacgaacacaagcttgaatctgacagaaaagacaagctcgctgctgtgctcggactcgatcctcgtcaagtggccgtgtggtttcagaaccggagggctcgtgataagactaagaagattgaggagacctacgctaccttgaagaccgctcatgaaaatgtcgtcgtggagaaaacccgactcgagtctgaggtggcaacgctgaaagagaagctttcagttgccgagaaggagattaagaaaatgtcagagctcattgaagggatttcactcaataatccgagtgccacgatcccaacggacatggacaccgtggactcaccgtttaccctggacccttttgctggtaatcttgggtggtttgattatgaggatctcctctacttgcttcaacagaattacatttctgctgccgagtggctcttactccacacctattaatccatcaagtgatcatcgacgtcgttgatttaggatgtgggcttgtagataaatgaccatctaatgtagctagctaggtttctagt

SEQ ID NO: 10147 - DNA, 780 bp, Citrus sinensis
  Predicted polypeptide sequence is orthologous to G1543
tcatcatcacccccttcaacaagccggaggttctgcgatgaaggatttggacataaaccaagtaccatcagaagatactgaatggaataattggaacacagcaacagcaacaacaacaggatcaggaagcatggacgatgaagaagagagctgcatcaacgttgacggcggccctcctcgcaaaaagcttcgcctctccaaagaacagtctcgtcttctcgaaaagcagaaagaagaactggctacgcagttgaagctgaagccacgtcaagttgaagtctggtttcagaatcgtagggccaggagcaagctgaagcaaacggagatggaatgcgagtacttgaagagatggtttggttcattgactgaacaaaacaggaggctgcaaagggaagtggaggagctcagggctatgaaggtgggcccacccaccgtgatctctccccacagttgtgagccactcccggcatcaaccctatcaatgtgtccacggtgtgagcgcgtgaccaccaccgccgttgacaagggccccaccaaggtcaccaccgcctcctccactcccgcggcattgtctcctaaagtcgggacgccggccctccagtcacggtagccttcggcggcctgatggaaagttaaacgtggcaaaacattaatcaaaagcaaaaggagaaattagttttagaggatgttcataggaaaagaaatatgcaagtgtgcatgcaagataccaatgaagataagatactatcattgatatatatgtgtggtatctgatctgct

SEQ ID NO: 10148 - DNA, 917 bp, Citrus sinensis
  Predicted polypeptide sequence is orthologous to G156
cgaattggggtaccgcggccccccctttttttctaaaaggagtttaattaaaacttcgtttcgcaaacgtgcagttacaaagaacacccatttcaataagcatacttaaactaacaagtttagagttcgaacaaacaaacacaatagcatatgtatatatatttataagctatatgtaagagtccctttatatattttgtcgtggcactattgtttcttcttcctgatcccagaagcactttccacagacctaatcacccaaaggtggggaaatgaagaccgaaatcttgaagattaggctgagtaggctgcagtcggaagggctgataatgaggaattgcaagctcaagaacactgctgggttgtgcctctccagaaaatggaaactgatccagcacttgtccatgttcttcaaactttgataccattgctgcctgctgctgctgctgctgctcccatgccatctgattgttattatccttaagcaggctgaatatttgctcattctcctcctccaacattttctccttcctaagaagattgtctgtctgctgccgtaagatctccatcttcctagctcgaaccttcttgactgaacactccagttgatgttcaagttgagtcaactcctcaagtttcacagagttcaagtcaatatcacccgtgtagcgtcggagactcaattcaagattgtgagtttctttcctcattcttcctaactcattgtaaattgcttccgaatcctgattgttaacgccggctggaattctcacccctttagcagcctggtaccttcttatgatttcttcaatgctggttgattcactgcagaattcggtcagttttccagtgcatgagaagatgatgaggcctatttcagcatcacacagcacagagagctcacgagccttcttcaa

SEQ ID NO: 10149 - DNA, 902 bp, Citrus sinensis
  Predicted polypeptide sequence is orthologous to G157, G1759, G1842, G1843, G1844
tttttttcatctaacctcctgccagtttgtgcagttttttaaggccattatttataaattgttgtctcatatgttgttgcatttctgctcaagcatggttacacaaatcacaaaataataaaacattctgcaagtttgatgatggcagatgataaaaacgcagtcagtgggaacttctacagaagccgctccctgattatctagccgccttatagtagtacagagcattacaatttattcgctacgtagaattagccactgataacagtcttacatattcaccaagtacaacagatgggcggctgaaaagtacacttggaaaagcgcctctcctcagcttatctaagcaaagggagggttgccatagacgctgctgttgtatcattaccactcttctcccctgctgcaatctttccctctagaagctttttctcttctctcagcagcttttccttctcttggagtgttctaatggatcccatcatcagttgtgtcttcacagctctaatttctgtcagtgtattgttgagtagattctctaactgcagaagatcagctgcagtgaactgctcaaagtttggaccttcaagttgcctttgaactattttcagcagttgcaggctcgaatatccagcctgagggtcctctgccttaggtgctcctgaagctacagcttcctctgtaatgcgactctggtagcgctcaaggatgctggccaaactgtcggcgctacagaactcgtaaagcctaccgcggctggagaagatgacgagcgccaagtcgacgtcgcagaggacggagagctcacgagccttcttgatcaatccgctacgccgctttgagaacgttacttgacatcggcttttgttttcgattcgctgcagttgaagctttttccggcc

SEQ ID NO: 10150 - DNA, 903 bp, Citrus sinensis
  Predicted polypeptide sequence is orthologous to G1635
taaaatagcagcatttacttgaacattaactcgccaagaaaatgaaacttgttttcagatattatacaaaaaggtagaacagaattggtgacaaaaaggaattcacagaccaaagaaggaaaaaaatcaaaaggaacgtaaaaagctataatttcaacagagagaaacggcaatttaaaattgaaacatacaaaccggacacctactaatttgaacagttgcagataaaaaactcggtgactagataacaatttgcacagctgtggaattaatacgcattacttcatttaccatcccctatctagcagcagaagaccgcttcagtcaaaacattatctgtgctacccaaatcagttcctcaagtccttgaacaagagaactatctactaataagatcatcagctctacaaatcatcggctttcctagaaatatgggcggcatctttaccattccctttgatctcttccattgcctactgctgacaattgattgtccctttccactatacgttttttatacggcacaaatcctttcatatgcttatctgttctagttcttatcacagagaaggcagaattctcacttggtttaagctcaaaggctacctccagccacttatcctccttatccaaagattgccgactactctgagagtcaacatcagaacttttgtcaatactgtcttcttcattaactgacttagagttcgaaccagtcaaagatccttccttcttgaattctctaccctgaacctccttaacactagaatgtaaacgtaaattttgcacctgctgattatttggagtgacagcatatggcaaaccatgagagaaattccaccatggaagatgagcaccagaaccagtatccaccatatttgagtcatcatctgtcgattgcat

SEQ ID NO: 10151 - DNA, 885 bp, Citrus sinensis
  Predicted polypeptide sequence is orthologous to G1635
ttgaaatcatctttttctttttcccttttttgacaaagaggaagtgtaatttctgtttgtttgagctacatagaattggtagattttgaggaaaaaaaaagaaaaaagaagaaaggagtatgagctttaatttatgtatggtgattttgattgcggagaagtcgaagacagcgggaactgctgttattgcggagagtgttgattcctgaggcaatatttaatcttgagaagagaaggagatcttgcttagttacaagaatatggctgttcaagacgaatgtggaggtaatcattcaaattcggttttctcggctggcaatggaattgaatcaagttctggcctgcatactgtaactggtcttgaagtaaaggatcagttttcttgtgggaacgattttgctcccaagccaagaaaaccatacacaatcacaaagcaaagagaaagatggacggaagaagagcataagaaattccttgaagctctaaagctgtttggtcgagcgtggcggaagatagaggaacatgtgggcacaaagactgcagtgcagatacgaagccatgctcagaaattcttttctaaggttgttcgcgagtcaaatggctgcagcacaagcccagtggaacccgtcgaaattcctcctcctcgaccaaaacgaaaacctatgcacccttaccctcgcaaattggcccatccacctgttaaagaaagcctaaatccagagctatctagaacatctttgtctccaattttatcagtttcagaacgagagaaccaatctccaacatcagtattgtttgcaataggctctgatgcctttggttcctccgattcaaactctccgaatggcagcttgtcacctgtttcatctgctgtccctgaacagc

SEQ ID NO: 10152 - DNA, 792 bp, Citrus sinensis
  misc_feature (48)..(52): n is a, c, g, or t
  Predicted polypeptide sequence is orthologous to G1638
ggggagctgaagagacatcaaaccaaagcttcgttatttttttttctnnnnncagcttttaccacttaaattatcaaaagccactctgcttcctctgttttttgcatttcttttcattgtttgttaaggaagtattgtacctcacttgaaagttttaaaatttattaaagggttgtgcttagtctggcgatatatgatctgggttttgtttattttcttgttttagttttggtttatattggtggtgatgattgttgatcgtctaggtttgtgttgtgattaaactgagatctgcttttactctgttgtttctggaattttccttgttttttggaaagttgaaaacttttttcagattcctcaatttgtgcttgtctgaaaaagtttttgctcatattccaatcaaatgccttcttgatttgatgcttcttttgtcatagaaaaaaacgtccactcctctgcatttgctatccgggttctctatatttcagagagagaggtcttttatctgctaaattttgtaagccatctttgttatgctagctagattttacttcacttgtaccgtctaaaacgatgagccgaggaattgaaatcctctcacctgcctcgtatcttgaaaactccaactggttgtttcaagaaagcaaggggactaaatggacccctcaagagaacaagcagtttgagaatgctttggctgtgtatgataaagatacccctgatcgatggattaaggtagcagcaatgattccagggaagacggttggtgatgtgatcaaacaatacaag

SEQ ID NO: 10153 - DNA, 1001 bp, Citrus sinensis
  Predicted polypeptide sequence is orthologous to G1638
ttttaaaagcacaagctttatattaataagcttctctaatggttcagagatccagaattccaataaatgatagaacaatctaactgatcagtgtagagtctgatactatggactcacttgactcctcatcaacatattcacatataaccaagatgctgaatggatgaagtaccctgacatcactgactaagatgcctcatataaataccttcagcattccccccattatgtacgttcactggtgttgcatggattgcatctgaaaataggcactgtaagctccaaactgagatccatttagatttcctccaagcagattttgttcctgcagcttaggtccatatgaagaaattccacaaaaaggagccatgaatgcagtcccattcattgagttgaaaagcatggctgttccctcgttttgtgatttccagttaaattgctcattactcatgtctaccatttttggttgctgctgcagctggatgactgcagcggaaggactgggagatggaggtttattattttctgatgaagaagttgcagtttcatccaggttaacagttgtaatatcatggatgctagatctcctcttatcctttcccccagtaagctgcctattgaagtacttctgagcatgacttgccacctgagttggggttctagtggtcacgaagttgcgggagatatttctccagtcccctttaccaaactttttaagacccattagaaattgcctgtgttcttcttcagtccaaggaactcctttctttctctcttgatcagaaggccgagtcgatgagcctctcttaccaccaggaccataaaaattcttcaaaccatcatatccttgattgctatcaacccactccaatgtgaaagaatcattaccataaccaggaattggaattagcccggcttcaatatcactaacatcctcttccaattccttgtattgtttgatcacatcaccaaccgtcttccctggaatcattgctgctacc

SEQ ID NO: 10154 - DNA, 497 bp, Citrus sinensis
  Predicted polypeptide sequence is orthologous to G1640
tttttttttttttttttaaaaaaatccaagcataaaacttattcaactcatcaagcaccattagtattacaaacttaaacctttgggcatctcaactaagcaaattgattacaatattttgaagctctaccacaaacttaataactaaaaaaaaaaacacttattgacacccttcaccattaccactatcccaaaaccaaaacaaaaacttgtcatctccatcccgtaattcacactgattataacactcaccaccacctggtgcccagtcaaaatcaagccattcctcatcaaagcctgaaaaattcatcattgttggatcaaatgtgtacaaaagttcatcctcattaaaaccccaaaaaacgctttccttttcagcactttttgccattttgtcttggtcccttttcacttcgtcttctgcacttgctttttccctgttaaggttactgttaactcgctttatttcactatccagccactcgtacggtcccaaa

SEQ ID NO: 10155 - DNA, 933 bp, Citrus sinensis
  Predicted polypeptide sequence is orthologous to G1646, G715
ttttaatcagaatatttagagggaaaaagaaaacagatgattcacaaatccagaactgcacattagatataattaggcaagtcactgcagctacagtttttgctgcatgaaatcaagttaaaaagtcccaacgagttccgattaaagtcatcacatttagaactggttttcctaaacattacagacaagtgttctcataaatcagatgcaagcaaaattccatgtagcatcggcaggggttccaatgcctttctactgcatcacacagcagcataacatctgcatattagttgtttttgtttaacctagccttgaccatcaagattggcaggtcccccgctcccaccactgccataagagccgtcgtccccagtccccgcgggcgtctgccaaacggactgccaagcctgactaggcggctgcacgtaaacaccagtaggatcgacagccggccggccaatcatcatcccaccggggccagcagtcccagtgggctgccccattggaggataataatacggaaccccactggcagtggcccccaccatgccgcccaagccggcagcctcgtccttaatctcatccctaggcacaatatcgaccaagaagtcgaagatgtcggtcctggtgatggcggccgcgatgtcgttcttctgtagagtcctgcgcttgttctcctcggcgtggagccacgagcggatcgtgagctcgaggatgaacaactcgcaggccttggcgaacagaatcggggcctcggcggagatcatgcgaacgtcctcgtcggccttcatgattttcttgatgcgggcgagcggcagctggtggttcttgaagtcgttcgcttgttcgatttcttgccgctggtaggaccagaacatttggagctgctgctgctgctgttggattaggtgatgaaacggcgccgttgcggtg

SEQ ID NO: 10156 - DNA, 866 bp, Citrus sinensis
  Predicted polypeptide sequence is orthologous to G1777
ttttttttttttaaagtataactattttacccaaaaaaagggcaattcactgtaaaatgattccgttctcctttgtccccaaataggtttgtgtgtgtagagcttttttattatctaagtgtcaacaataaggaatttttgaagctttctctacagctgctgagttgaaaggagctattttatgaaccgaatgcttgagagaacccagtagatccgcttcaatccattcgtacaaattccggcagagataatcagcggtgactgattgagtaatgaccctcattctgaaatccttaagttggtgctcggaatatttctcaaaattttcttctaaaatcaatgaaagcctctcaatgttggtctcaaactgctgctgttggtcctcaaaaaagttttgctttattttcctttcctctcttgtcatctcatttttcaacaggtcatcggcaaacatgtaaaatgcaaatgggtacgaaaatgaaaggatccgccttgctctaaagagcttattcagtccatcctttatccagccaaagtccttggatgatgtgtccttttcacccagtatttttattttatcctgtatgtcttccttcatctcatactcaagcctaaaagattctgtatgagctttgtacagtttgtggcagtgataatagctttcgagcctccacttcccatgctcaggtctcttttccgaaacttctatatatccgtttgaatattccaaaccggaaatccaattgaatgtgatcccacacttgcagcgcaccatgttgcaacccccattcttttcaattggcttgcaacattttgggcaaggttttgtgtgggaagagatccaattaagcgaaagggattctacc

SEQ ID NO: 10157 - DNA, 411 bp, Citrus sinensis
  Predicted polypeptide sequence is orthologous to G1781
ttacttctgaggtctattacaattcatcatcagaaactagcagcgaccttttcatttgaagaatatgcaaacctccatgtgtaatgagtggttggagggtatccttcctccaatccttataagcttggttgatgatgagaaagtgaataatgacaaccttgatttttttgttgttcctcagtatgggagaaagcctgattatactggttaagtgtatgtaatgttactcttttgtgttatttttaattaaataaaaggatgggtactgttattacctgtcaatcatgtaagtgtcaatttggttttattaaactattaagatctcttgaggtaagcaagagatttcttttttaaaaaattttgagtccatgtaatttgtcatctttaataaataaaattaacatgtgttaa

SEQ ID NO: 10158 - DNA, 613 bp, Citrus sinensis
  Predicted polypeptide sequence is orthologous to G179
tttttttttttttttttttttttttagcaaggaacacattattaatcattataaagttaagaaattagtcactccaactcccaccaccaccaaatataataataacaacattaaaaaatgtgactaaaaagtacaatcctgaaaaaataacatatacttccagttgcatcattacatagcataacaacatagcatcgatactcctgcttcccgccacttagcagcaattgttattcggcatccaacttccaagtaaaaacctgaattatgaacagcagactgtcctctgttcgttcaatgcaaaacatcctctcataatagtctcttcaatctatacttgtacatatcccttttcttcaatccttttactttttcctctctctctttttttttttttttctcccttttttgatcttttagacccaaagtaatgtatcgaccagacaaaagctaaggttcacttgatttaacaagaccacaaaacagcgacagcagcactgcagcagtaatgagtttccctgcttgacatctttacactagatcaatggttgtctttactatttgcacatattatcccgaaggaaatcatgcatatcacggctactagccacac

SEQ ID NO: 10159 - DNA, 814 bp, Citrus sinensis
  misc_feature (757)..(757): n is a, c, g, or t
  Predicted polypeptide sequence is orthologous to G1804
ctcacagccacctgataacaacaacaacaacaacaaccaagacaacgaaccaataatgggcaacaaattagtcgtcgaaacggtcgaaccggccgccacattgacccgacagaactcattttccatccctatccttctctgcaaaaaccgtggaggaagtatggtccgaaatccaaaaggaccaacaaccccaacgccgctgccatgtcgagccacctcagcgccagcctaccttcggagagatcactttggaggagtttctcgtcaaagccggggttgtccaggaaccggccaccaagccttgtcctcagtcacattcgccgccaattcatcgaagtaacaatgacagcaacaacaacaacaacacgtgtttgggttcagcatacggcatggggctgggacctagtgcgtgcactatgatggcgttgggattttctgctactcagccgagcatggggagcaacttgttggtcaatggttatgcagcttacccaatatacactgcaccaaccgaacttgtgggacagctagctagtactgatagcaacaatggtgatgataaagagaagagccagggcatgatgttagaggctgttggtccgaagggcaataggaagaggatcatagatggtcctcatgaggtggtcgtcgagcgaaggcagcgtagaatgatcaagaatcgggaatctgctgcgcgatcccgtgctaggaaacaggcatacacagtggagctggagctggagttaactcagctcanagcggagaatgataagctgaaagaagctgtgaaggagcttgaaacgaagcgagtaca

SEQ ID NO: 10160 - DNA, 919 bp, Citrus sinensis
  Predicted polypeptide sequence is orthologous to G1804
tgggtgcgggattcagccccatcacatttcccaattaacatgcatgcacaggtggtgacgtcaacccacaacaaaattgtgccgtttatcccgcaaattgctttttctttcccccaaatctttcatcatttaggtgttgttgctttgcttccacagcatttgcagtgcaaaaatggtggcaccagagccggaaacgctgtcccaaggcgaggtggaatcagcattgcgggcagaccagcaccagaagacattgacgttactcggacgacaatcatccatttactcactaaccctggatgagttccagcacacgctgtgcgagagcggcaagaacttcgggtcaatgaacatggatgagttccttaccagcatctggaacgccgaagaaaaccaagccatcaactcatctacccaagacagtaatatcaacgccaacaacgttattaacaatgctatgagcaataaccatacggtacagcatcttcctgtcaatgaaacaacagcggcaacgacagcccacggaagtatagtcaagcaaccgagcttgtcaaggcaagcctcgcttacgcttccggcgccgctgtgtagaaagacggtggaagaagtttggtctgagatacacagaggacagcaaggtgggcaccagcagaatagtagagtgactgagaataatagcaataacaataataatgtgcggaatcctgaagctgcatcgcggcaaccaacttttggggagatgacactggaggatttcttgattaaagctggtgtagtgagggaacagaacaccacgccagtggcgcagcctccgccgcagcagcaatttgggatatatcagactaataataaccccgtgatgagtcctaattttggcaccgggcatgtcctgggactgactggtgttagtaatggtgctagc

SEQ ID NO: 10161 - DNA, 875 bp, Citrus sinensis
  Predicted polypeptide sequence is orthologous to G1821
ttttttcagtacaattttttttttgttgtcagaatgaaaaagaagagaaaagaaaaacagttaaaaacaccaaacttattctctcactaacaagaaactgagcaggtggttatttggtcacattaattagcaggtctaggtagagataggttagtgcggcttgcgtttcatctatctgatcagcactgtcttatttgttgtgagcataagtttcaccattagcaacggcaggctgtgatgaccccgccgcagtattattattggaaggatcgttgttgttgaagtaagtccccgtggcagcagcagcagttgcagctccaagaaagccatgtccacgtcccagtcccatatggtggaaagctgctgctggggccgcaaatgctgcaacacccagtgtacgaaactcaaccggcggcctcttgaccaacggcggctcgcccctgattgaaccccgctccccttccatttcacggtagcggtggaggtaaacagtgagcggctcgatgtaatcatcgaagcccagcttgctcatcgcccaaagcacgtcctcagcggtaatggtcttgcgttgctcgcgctggcagcgctcgttggcttcgccggttatgaagctgatgtactccgacacgcattcttgaattgtttccttcgcgtcgtctgagattttggcatgctggggaaggattttgcgcatgattcttataacgttagcaattggcatgaaacggtcttgttcccgcactgtgcattcgttgtcttcataatttgtgtggttattattattggtttgattaatctcatgagccgatgctagtctgatattcgtctctgtgaacttcagccctggcccacggcttgcgttggggagctgctgg

SEQ ID NO: 10162 - DNA, 886 bp, Citrus sinensis
  Predicted polypeptide sequence is orthologous to G1850
tttttttttttttttcattctaataattgagctcgatttccttcggacggacgtttcccccagtttatgaagtaaaataaaattaataactgcgacatattttatattatatactctatgatatttcatagtctaagctcaaaccaaattataattgaaagagagaacaatgcaagacgaagattattatgctattaactagtgaattatatatattatttatttcttatgagttctaaccaacacgtttccgcctattatcagggagtttcatttgacctgccatttccatccaagcgtgtcccttttttaccaaaagcaaaatccccgcaaatattcctctggcggggcccaccccccactcggcctccagaaagttcaaggaatcacgtgtcacatttcagtttagcacgtgtttgttctgacacgtgactgatcaatctaggcgctacctaaccccttttggatcatctaatcaattacacaccctctggttaggcctgtggtggctctgccgcagccacggcgtttcttgacgatcgcagtgatcgccgccgccgccgccgcccatctgataatccaacggctcggattttaactgcagctgcaaacgagtcgcgttctccgccgtcgacgaggagggttcaccgccgcagtttacctccctcgcgcgcttcgcgcctattggaacaccgaacaacctcgtactcatttcctctccctcaccacaggaaaaccgcttctctgataacaactccatcgccgcctgaccgccgccgtcaccaccaccaacaccaccacgggtgtaattagacatcaaactaaatatattgttacagagattcttcatttccgccacctgcttgttcagctgagcattctcctt

SEQ ID NO: 10163 - DNA, 871 bp, Citrus sinensis
  Predicted polypeptide sequence is orthologous to G1850
tccgcactcctttcacatccccaccttcctcggatcaaaaagcgcttgccttttaataagcaaacaatttgaccggatccgcacatatcatcacgtggccccatcaccacgtgcaccaaccatattaatccatatcgccgtcagttctcacgatttacccagttctagccaaggaggttcctgatgatgatcattattcgcatccaacggctctgatttaacatccgaccccggctgattctcaccttgctgttgctgcagttgattcttctcttcttcctcttctctcctcgcacgcttcgccccaatcgacacaccaaacaacctcggagtcagatccaactcctccgcctcctccaccttcgcgccgccttcatcggccttcctcgccggcagtatctccaccgtcttcccctccggcagacttacgttgtccagctgaccggaagcgtaattcgtcattaaagcgactccggcatcgtcgtacaactcgtagttctaatcacggtcgtagtcggcaccgccaccggcgacgaattagctgatatcacctgttccagccggagttcgccggcgaaatctaccgtgcaaccgcagcgaccgtcacagtccccgctgtggcagctgtgaaccagaacagggaaacaagatgcagcagagaaaatcaactgcgtcggggcggccatctggcaccgacggatctgatttttcgtatcggatggtcgtcgattcccgtaagttttcatttttatgataacaggatcataaattcagtatatgcatttgatttgttggtaaaatttaacaacaggatacacaaaggtggctagagggaagtctcgtctctctaaactcattttcgctcaggctg

SEQ ID NO: 10164 - DNA, 943 bp, Citrus sinensis
  Predicted polypeptide sequence is orthologous to G1855
ttttttttttttttttgtaaatattctctcttgaattgctatactcgtcctaatattttggtaaataattttatgtgatacacagtaagatataaatacatcaatacaagttgggaacgagtattttctttagctcagaaacttaaaagtcaataaattaactacaatgaattgtgaaccaacaatatcttctcaggatggaaacgccctccgtcaccgtgtaacaactgacaattcaatctcattcgatctatgatgccttttactttcacaataatgtcgacgtgatctcttattatgatcgccccttctgggcgaagaatgcgatgcatctcgagaaggatatagacaatgtcacacttgtccatgtacatgccgaatacaccgtcggcatgaatcaaatcgtatgttctggggtatgtcgagaaggcctcacaccaatctatgtaggtcccaatgagcccgcgctcatacaaaatgctgagggtattatgttttgcatcaaatggaactgcattcatgacccaaactggatacttagccagtgcggctgcaaagccccctaagccagcattcatgtccattatatttctgaatttaccagagaagagagattcgagaatgattctgtaatgggaaactctctttttccacagctgattgtcttcgttaaaggacttaactgtaatgccttcaataaacccacttctgattcgaggtggagcagtattcaatctctttggccatttttcaagagcaccgccggctacatctttgatttcattcaccattggaagaggagtaatgcatggttccatcttcgtgtacagcaattggtcccctctctgctatctttttccagcataatcgtgtagcaagatttttcaagctgatctgctccttctgcagatccttagcatctctctcccaacctctgtaactg

SEQ ID NO: 10165 - DNA, 830 bp, Citrus sinensis
  Predicted polypeptide sequence is orthologous to G1863, G2334
ctttttttttaaggcaatcaaacaacacaagcacactcaatttatacaagagtcaccagaagagtgtcacagtttcgttataccacgaatctaagaatcttttttttttcaaaaaaaaaaaaaagaggaccaaatgaaaaccaaattatttagttacaaaatcaccaacaaaaatcaggtgctaacatagctagcctctgaggcagaactgcggggtaattgatgtagaacgcttgttggagatgaattagaattggaagtcgaagatcgcagagcctctgctagaggtcctcccatcgaagccaccgtgtgagtggcccatcctgccgcccaattcagctgcggctcctccctttcaccgccctgggagccgggttcgtctatattgccagtggaaagtttcaaagacacgtcagatgacgacaaattgcccggcatcgaaatggagaggcaggtggcagaattgactgtgctagaattgctctcacaattgttgtgatcgtggagtgaccgtggccagtcatcaaaaaaaggcctcaaaatgtgaccatcagacctattaccaacctcattttggggttcaaacaggcccttaacagctttggacacacaggaactttgattgaactgaagaagatcaatggaaggcgaatgcgcggaaagagcaaaagtagtggcgttagccatttgagcaaagggtgaaggagcagcaacagttgcagcagaaatattattattattattattattaacggtgctgctagtggttttgagagtagtcctagcagcagcagaggaggtgggtgtggggatttccacatgctttcttg

SEQ ID NO: 10166 - DNA, 894 bp, Citrus sinensis
  misc_feature (794)..(794): n is a, c, g, or t
  Predicted polypeptide sequence is orthologous to G19
aaaactttctcatcccaacacacaaattagaagagaagaaaaaataatatgtgtggcggtgcacttattgccgattatgatgaagtcaggccggtcaggcgcgagcgcaaattgacctccgaggatctctggtccgagtttggttccatttccgacctcttgggcttggactacaatggcaaatcccaccctaagcaacctctcaaagtgaaaaatgagaaggctgaagattcaagcaataaagctgctcgtactgagtggaaggagaagaagactcagcgagttcgcaagaacgtgtacagaggaatacggcagaggccgtggggaaaatgggcagctgaaattagagacccttacaagggcgtccgcgtttggctcggcactttcaacacagccgaagaagccgcaagagcttatgatgaagccgccaagcgtatccgcggcgacaaggccaagctcaacttcgctcagccgccgccgccaatagctccacccccggctaagaaacgctgcatgccatcccctgagttgactcagccgagatttgaaaccatcggaaccccaccggctccggcgccgtccccgtgggtggggtttgggtatcagaatgagttttatcaacccagggcagtagacgacgagtttgagctgagccagcaaatttcgcgcttggaatcgtttttgggattggagccattaatgagtcagccgagtggaaacgttgctggtgggtgtgactcggtggacttttggatgcttgatgacgtggcggcgactcagcagctgaacagcantcagttcttgtgttaggaaaaataataataaacgaattgagttgtggccgtgctgtgtgttcgtgtgggtctgtgttttgagttattgtgtttaatgctg

SEQ ID NO: 10167 - DNA, 873 bp, Citrus sinensis
  Predicted polypeptide sequence is orthologous to G194
caaaaacccatttcacaatgacattcataaagggtatgcgggaaaagactttctgcaagaaagatcagatcctgtcaactagtagattacataacatttacatctaaaccttttacggaagtcagttaaatagaaaaaaaaaaaactaataataattaaattgataatcaatatactcatcttccttcatctctactcttcccttagcatatgtgaaggaacaatgtcctgaagaaggccatgatccttaagcagatcagtccctgctgcaggagtgcagaaacgcctctcatgaagaaaagaagcagttgttggaccgttgataaaactactcccaaaattcataggcaacaaggaattaaccaagctgggcagttgttgctgagagaatgccgccggcattggcataccaaaagaggatccaacgacaccgtttccagcatgaggaacaccgccaagggttggacgtggtaggagtggactcgggtggttgtgctggccctcgtaggtcgtcacgacaatgcttggatcagtgtaagatctctccactcttttcttcacattacatgaagcactggtgcaacgatagtaactcctaggaaaggggctgtccttaacggccttctgaccgtacttcctccatcggtatccatcttccagatgatcaacctcgctctttgtcatgaacgcgaatctcggctctctctgtcgtttctgatttgtcttcttgggcttcaactgtttcttggttttttgttgattttgttcatcatgtacatgctcttctactttaacttgttcatcattcaaagcctcactcgatgcagatgaaatcgaggaagagttaggcgtcgccggctgattcaacaactc

SEQ ID NO: 10168 - DNA, 831 bp, Citrus sinensis
  Predicted polypeptide sequence is orthologous to G1944
gagggggaaggaaaaaaccggcctacggtgaaaatcgggtaaactttttcttgagaaatatttttctcaagaaacaaacaaagaaaattattttctttgctttttattttttgtaaccgaactgtgatttttggagatttcacttgagagaagcttctgaactacactgtttgagctctgcaaatgtgaaaaaggtctgagacagacagtttcagttgaggtgaggtctggccgttatgctgatatgagtagtcagagttggcgaaaattggatttttgaataactattaatcaatggaagcaggagaaggcatgagcacaggagttacagtgataggagctgaagcaccatcagcctatcacgtggctccaagaaccgaaaatccaacccaggtatcaggatctctggcggtgaccacgtcccctgttagtgtaggattgactggcacccaagaaaagaagaagagaggtagaccgaggaagtatggtcccgacgggactatggcattgtcacccatgcctatttcgtcctcagttccgccttctggtgattttccttctgggaagcgaggaagaggacgggttagcggtcatgaaagtaagcactacaagaaaatgggaatggacaatttaggtagtgtcggtatcaagctgtctctctagctgcatttgttgcattttggcactgttttagctagctctgaattactgaaatggatatatcataatactgtgaacatgcaaggttatatatttgatgagagtgaaatgattttgttttgttgaatatttattggtattttctgcatttgactgttgctaatttcttat

SEQ ID NO: 10169 - DNA, 864 bp, Citrus sinensis
  Predicted polypeptide sequence is orthologous to G206
gggtcacattgtattcgtgctttgagatcaaacaatttgatcagagagaattaaaaagatacatagcaaagttaaatatactgcggtggtccaaaaatggtgagagctccatgctgcgagaagatgggattgaagaaaggtccatggactcctgaagaagatcaaattttaatcaattacgttaaactttatggccatggcaactggcgggcacttcccaaacaagcaggtttattaagatgtggaaagagttgccggctccggtggataaattacttgcggccggatattaaacggggaaatttcaccagagaagaagaggacactatcatcaacctacatgaaatgctcggaaatagatggtcagcaatcgcagcaagactaccgggaagaacggacaacgaaattaaaaatgtttggcacacccacttgaaaaagcgtctcaagcaaaagcaacaacaagagcccgtgattaataatcatagtaacgctaatcatgttacggcgagatccgagatctgcagcggcgccagtactcccgatcggcagactcgactactacttcaagcgacatgtcgtccgtcacctcctccgcggctaataacgcttgcgtgaaaacagagccgtcgtcgtccgaaaacaatcacgacagcttggttgaaatagatgagaatttttggacggaagtgttgtcggctgagaactcgggcattagtattgaggacagcaatgatcgtttttcagcggttggaagcgccgacccactgtctatagttgaatttcaatcatcactcgatgattttagaccaggttctactttgtgtgataacaccgacttttggttcaatcttttcaccaaagctg

SEQ ID NO: 10170 - DNA, 666 bp, Citrus sinensis
  misc_feature (656)..(656): n is a, c, g, or t
  Predicted polypeptide sequence is orthologous to G2071
ggggaagaaaaagcggtgctctggagaaagtagttgagaggaggcatagaagaatgataaaaaacagagagtcagctgcaagatcacgggcacgcaagcaggcctatacattggaactggaagcagaggttgctaaactaaaggagttgaaccaagagttggagaggaaacagttttgttgttgcaggcagagaaaatagaaatggaaaagaataagattatcgagaaaatgaagtaccgatggggaggcaaaatactgtgcttgaggaggacactgacaggcccttggtagagtaaaccagttgagctgctgataatagaaagtttgtttgaaaacgcaatcttggctgttgatatggtacgagaattggtgtgcacatctttgatctatttctcataccatggagtgtaggcagctgcatgtatagaaaccaagtgttgtaaattattaaccgaaattagttttatactgtggaccaaacgtctaatctgtaagacttctgtttgcttctggtttgaacagagaagtattgtaggatagataagcagactgtacgctttaagtgtgtttttaccggctacttgcagacttggttagtctctaaccttctctttggagttgaactttcaataatatatgatctatttgcattttngaaaaaaaaa

SEQ ID NO: 10171 - DNA, 782 bp, Citrus sinensis
  Predicted polypeptide sequence is orthologous to G2085
ctttttaaaaaacttaccaacatatctactaattgaagcttcatgtgatacatttgaagttcctttttgaggtgatctcaagcacaagtaacaatgattagagtgagacaacctcatatattgaagggactataatatctgtacatataagacaagctaaaggaaattactagaaaaccttatacttgaatgatggtagccggaccactctaaccatataggaagaaaggacttagtgctcggatattaaagctgaatcatcatcattcgagaaagaaactagttcgttgtctgtatgagcggcagttccacagtccgagtcattcacttcaccttcaccctgctcagctggagtaagaggttggtcctccattttctttccgagatcccttaaagcacccttgtttgcccaaaaaagaccacaggcattacagagggatcttggcccagaaggaccacgtcgcatcattggcgtagacttcgaactaatgccacaatgtgtacacgaggtttctgatgggctgtcgtcttgtcctggatcctgggcattactccaaccaagagctcccccttcacacttcttggctgaagtaaattgacctttgttccgctgcatcctgagagcaacctcttgccggacactgtatctaactttcttatcaaagcaacgctctttcctcttctgccgaaacctatctaatgaagctgctctttgtggttgggtacatttagcaggatagtccgcaatacccctctggctgtgaggaattacttccatgccc

SEQ ID NO: 10172 - DNA, 740 bp, Citrus sinensis
  Predicted polypeptide sequence is orthologous to G2094
tttttttttttttttttgttgaaaaaactcatcatcataatatcatttgggcaaaggggacatccataaaatcctagtattattcttattatgattattactgatttgattttttttttttcgggtaatcaactaagcataaacagaaccataagataaagccattaacaaaacagcagcttgctcttcttctccaagcttctttctttgcttcaccacaattgatcgttgcatcaaaacttctcttcccaatgcgtacaatctttgctttaatgaatccccaagcttattacttgagctattactgctgctattgctgttgcctctctttgattttttcgcctctttaaggattcccaatattgccctcctcttcttcctgctccttatcccggatgcattacacagtgacttggggccagcggggccaccgcgccacagtggggtcttggtgggcccacaatcagcacagggctttttgatactattttcatccgaagaaaccccatcaagcctcttgctgccgctgctgttcacttctgcggattccaatcctttgacactcggatccatcatgttaagaagatttgtcaagaaactaagactgacccaggggaaaaaaaattgaaaactgaagtgggttttgatcaaaacggaaggtaaccactctagctaatgatttggaatgaagctattagctggccggggctaaaaatgaatgaaggaaagaatgaatgaat

SEQ ID NO: 10173 - DNA, 812 bp, Citrus sinensis
  Predicted polypeptide sequence is orthologous to G2107
caaaagcccatcaaaagtcacttctaaaatttcaacttaaacttcatatcaatggattgcatatcgagtcaaggcgagctgctcactcacactcagacaacgaagttcaactacagattagcaacgagcagccctaagaagcgagcggggcggagagtgtttagagagacacgtcatccgattttcagaggagtcagaatgagaaacaataacaaatgggtatgcgagctgcgtgaacccaacaagaaatcacgcatttggctaggtacttatcctacgccagaaatggctgcgagggcacatgatgtggcagcattagccctgagagggaaatccacgtgcctgaatttcgctgactcggcatggaggttgccggtgccggcttcggcggatgctgatgatgtaagaaaggctgcagctgaggcagcagaagcattcaggctgtcccatgatgatgaagatcaatttgaagaaaatggtttgttgccggagaaaaatgtgttttacatggatgaagaggcggtttttgatatgccgggactgcttgtgaacatggcggagggtttgcttctttcaccaccgccactacttattggatgtgagtatgatgatgatgatgatacgaagtggaatgattatatatggggacattgaagtaatagctagctctgtgtcgttgcctcattgcctgtggatcggagtccttcgatttgatgtgcgtctagttaattaatgctgtagagttgtgtttctttttgttctgtctgtttagtttcagcaattaggaaatcttcaaacaattaggatacaaa

SEQ ID NO: 10174 - DNA, 335 bp, Citrus sinensis
  Predicted polypeptide sequence is orthologous to G2109
tgtatggaataatagtccccacaaaactttccaccatagaataataatagtaatgcatttctagcttgcactaacaaagtgtgggttggctgcttgggcatgtcttttaagcattttgttctattaaatttatcataaatcatcatcatcatcaccatcatcattatcttatggtgccactgccaacagcacctgtaaaggcaattacagttgagtttgacctttgtatttgctggataccaaatggttgagccttcaacacgcccatgttcttatcctcctatatgtacgtgcaaatgatgctcaaaaaaaaaaaaaaaaaaaaaaaaaaaaaa

SEQ ID NO: 10175 - DNA, 724 bp, Citrus sinensis
  Predicted polypeptide sequence is orthologous to G2109
tttttttttttttttaagaaaagccatcccagttttacagggacctctaaaggagatcgtatttatatatatacagatggtatatcaacttgtatgatttatatcctattaaaagctaacatatatattacacaaaattacctgatggccttcgcccatctctttgaattctctttatatatcagaaacctcatctaaaaatttgacaagcaacaccagaacaaaatgtatgtccacagaagtattttaccataatgcacgttcacttctgtgctaccagtcttcgcatccgatcaaagccatgttgactcaggaaagtctatttgtttgctggtggtaggaattctcatcaaacatggcaatgccacaagggccagaagcagaaacccaatcatgatgcccattgccgtacatgggtccagaaagttcaaagttgctattgacttgataaactgcaggatttccttgcaagttcatctcagcatcaggcttcaacttcttatcatctgaaggcaaattcaagctactatatggagggtatgaatattgctctccaagttgtagacttatgcatgcattgttactcaactcattcaagttgccacctccatgttccatattttcaacctgccctgaattaccaacctctatctctttaccagcgcccaagaaaccagaatagcttgaaatgtgggcatcttctgaacatcccatatctctttga

SEQ ID NO: 10176 - DNA, 701 bp, Citrus sinensis
  Predicted polypeptide sequence is orthologous to G2116
tttttttttttttttttccaaaaatggaaaattttaatttatttcctgttaataaaagtttaaacaataacaaacaaacaatacaatgggggcccctaacaaaaaaatatgcacttttctaccccttgaaaaataaccttctattccctgatgaatgcccctttgtctgtcaataagggcagtctatgaacaattcaacaaacatgttgggaccaaaaatcggcagcatttgcatcaaaatgggctgctgctttcactaacaaaaattgaggggccttcaaacttcactaaaagaaaatttctgccattgatatcaagcccctgcaatcttccaaaaggatcctgctgcaacatctctgaaaaggtatgtgagttggctgtaactaacataggctgatggggaattgacattttaggctgaaaaggatggaattctggcaattgtatgatctgggggtccccaggcccagtttgaggggggggcggaaaaaacaatgattggttatatggaattggttgcattcctaaattaaagggggccgggggtgtcatcatttcaccggttgcaaccttgaccctctccacttccttttttaaagcttcattcaaagcatcacgtaattgagcttgttgttccataccctgtaaacaaagtttaagctctgtattttcagaaaacaaatctgttgtgtccctctgga

SEQ ID NO: 10177 - DNA, 498 bp, Citrus sinensis
  Predicted polypeptide sequence is orthologous to G2130
ccaccccaaaccgatcaaacatttgattttgtaacgagcggctatgattccgaaaaagagtctcagtctcagactccaacgtccgcaataccttccccgacgtccgttctcaggttccactccaacgaggaaattgagctcgcaaaaacagagttgtttaatcttgagagtgatcgctgttgtccgtctcaggatagtttccagatttatgattcggagctgttggattctgcaactccggctccaatctttttcgatgataagatgtgtgtgccgcttttgaaagaaaatttgggtgacgtttctgtcgatttaggcggggatttcgattcatgcatttcggagtgggacgtcgataattactttcaagatcctcctcctttgcccgattcgcattgacggtcttactgttagttatcagttttgctctctccctcttgtccatccacaagtgtgatatacatatattttgccctctatgctctttatttattagcc

SEQ ID NO: 10178 - DNA, 988 bp, Citrus sinensis
  Predicted polypeptide sequence is orthologous to G2144
aatgtccaatagggctacacagttactttacaagacgataaagccacagatcatattatagagaagaaaggaagacttgcataaataagaacgcacgatagtccactctatgcttttacagtatgaatcaatcaatcatctcagaaattaagaattagattgaatgactctgaggggaaaattagtattctaattaagtaagagatacttataataaatatatttatatttatataagaatgacacactgaaagtgatcgtctccggtagaaacaaatctgggtttccaaatgactcggggtaaattgaagacaaatggtagcccaggatcaatgctgaggactgccctctactactctgctaaccgctaatattatcatcaatatatacagtacgaggtactagctactgctggagagattcattgcatcttcatagctccatcttcaattgatttgtgtgcagagttgctgaatttgctgaagaatcataactcaaaagtgagttctcgggagtaacaaagttatggctttcttctgctcctcccaaaagaggctggtgatgcccatcaaaatgatgccattgctgttgatactgttgtcggtttccatgggcttggagttcaggccacattacaggcataaccacgccagggaagctactgtcgattaacgatccactctctgcaacaaataagctgtccagattgaaatcaatccttggattgactgctgcaagtctcattgacaagaactccacttgacgctgtaacgactgcacatggttgatgatctcatctaaaactaatgctgtcccagaaatcttattgcagcccgggaccagctcttgtaacagcttcattcgtgcattaatcttctctctcctcgctctctcggccaagctgtggctatctgtagcttgaccgcgacgagctcggacgtgaacgtaaggaagtttctccgcatcttcgctgctatcgttagcgcca

SEQ ID NO: 10179 - DNA, 948 bp, Citrus sinensis
  misc_feature (928)..(934): n is a, c, g, or t
  Predicted polypeptide sequence is orthologous to G2226
gggggcaagcaagccattatcaattcaaaacgttaaacaactacttgcacatgagatagtgttcttagtcttttagatagactaagaaatttcagctcgtcctaatcttattaaacggttcctgatatttcatcatcgaccccaactttgggttggaattgctatcttcttttggctcttttccaggattctgcagtcatcatttttcctttttaaaaattttcgcttctcagatatcaaggaagcagtcacaagattttgcttgatttctgattcagtatctcaaatttagtacaaaattgggtatctgtaaatttaaaattttaattcgaaaacatgggcctcgctagtatgccgtccgcatcagaaggaatgctatgcttgattctaatgaacactgctatgtcaatctcaatcgtcaaaggcatattcagatcaatcctcaaggttgtcggtttccagcttgctgactcatcatcgccaccgtattcatatttcgcatcacctcaagttgtctccgcagagccatatgatgtaaatttaagtcctccccttagctatgttgaggagttccgaaaccagaaccctgcaatcaagtatgaaacattgctccattgtgaagatgcagagcatgactgttctgtgtgtttgaccgagtttgagcctcaatctgatatcaataacttgtcttgtggacatttgtttcataaagtgtgcttggagaagtggctggactatttgaatgttacgtgcccgctttgcaggacacctctaattcctgagtttgaagacgatccctcttgcttctggtgagagtgttttatgagcttgtctagttgaggagacttctatgtacagcatgtagtgtacaggtatttactaatgcatcggccggagtgtagtgttgtttacacgccttctatgtgtnnnnnnnatctcgagtccttt

SEQ ID NO: 10180 - DNA, 767 bp, Citrus sinensis
  Predicted polypeptide sequence is orthologous to G2239
gaggcctggggccttgccgaggaggattcgccaccttgcccaatcttcacgttaagacaatttaacggcgatttaactgctgtcaacaggttccttccgttcgaattccaaccatcgcccaatcccataccctcaccaccaactttaacgaaccccatcttcgaaacaaacggcggagtcattgaaaaaacccagcggtcggaccggccaatttgccggtccacataatttcttcctctactactcccttctcctccaccaccctttctggaactgccttccattgccagagcggcattgaaactcgccgttcgcttaagtttacctctcgtcattagctttttcctaacctcgtctggaaatcttagtgtgtacctctcaacgcttactccagctagaacaagcgaatgtcctgtcgaatgtgacctcggaaacctctctggcattcccaatctcggcggtcggttcctcatcggcgtcacgtgactcgccgcgttagtaatttcaagcacttgcgcgtcactgttgctttgctcgtcgttgatgtcgatcacagcgcgactttgctctccactgagttcagaagcggagttgttgtgagtctgattcgactcgttgtttgaatcgcataatttaacctttttgtttgattctggagtaaggttggccctacaaaccgggcacgtcacgtgagaggctaaccagacatcgatgcaatgaggatggaacacgtgatcacattttggaagtaaacgcagcgtttcgtc

SEQ ID NO: 10181 - DNA, 514 bp, Citrus sinensis
  Predicted polypeptide sequence is orthologous to G2239
gagcggttcacctttagactaccggttgatgtgaggaaacatataatgaaccggtgagctgaaccggtccaatagcttggtggttttgcccagggaagctagttcaaggaggggttaccgaccatgcggaggaggtgaaggtagtagtaaagggagaaatactcgggggctggaccggtctttcaaatcataccggtgggtgtttagcatggcaccgccatttttccaaagagcatcatcgcttaagactacaaaagtagcggccgatgatgcgcaaagtaattcggttcaaccggctggttcgtcgggtgagtcgagtcgaccgcccgtttgaacggcatattttatttttttaggtctaatttaattttaataataccacttttgtctagatttgtataatctttaaatttttttcttcatttttttcttgcataatttaattttaaagatcaatgtatgataattgacaatcctgaaagaagaagtcaattttgaaaaaaaaaaaaaaaaa

SEQ ID NO: 10182 - DNA, 951 bp, Citrus sinensis
  misc_feature (32)..(32): n is a, c, g, or t
  misc_feature (907)..(907): n is a, c, g, or t
  Predicted polypeptide sequence is orthologous to G225
cccctcgagtctaagctatagtataagcttcntggtttccagttcacaataggtgactctctctccgaccagttgaagattgaatcaatcacactgatacagcagattatatatcgtatgtggatggggtttgtcatttatgaacagatttctcaggtcaaagatatcgtacgtacatggggcaacaactctttctcaccaggagacggagattagagagggacagtaggaccccctatcagcaaccttttatactctaccgtcacaattacatcttgcctgtaggtaggtgctatcctgatcttgcctgtaggtgctcgctctatcccgagcatttgccctttttgctgtgaaaccggatgtacaaagctagctattcccaaaggccagaagcagaaatggattaccggggcggggacgaattcgtgaaattgcaaaccgcctcggaagagaacagcatgactggcagagcaactaacaaaagtaaaagtggaagagaaaaatatcttaacgctagcagagttcagaacaaatgaagcaaaataaaaaacggaagcagcgttactgctcccgattcatcttgacccccaactattttgacagttccagaagtgacagagatgcagagatcttggcgaggctctttactttacagggagcgatctggaggaaaaggaataagaaagaggaggaacgaacacctacccggaaaacaagatcatgggcaatagcagcaaggtgaaggtcatttccttcctgcacggcacccctaaatagatgtaaaaagttgtaaatgtaaaacttccctataaaaagctctttttcgtcgtccacactgcagttattatttttaggtaatagggctacaaatcgttactagtccatccattggggaatgcttggtccnagcgggggaaccttaacaatcgcactactacacctaccctaccc

SEQ ID NO: 10183 - DNA, 726 bp, Citrus sinensis
  Predicted polypeptide sequence is orthologous to G2251
gaggcttctctcctctcctctccttactgttactactttttctcatttacatcttgcgtaagcaaaccttcaagtttctatcattcatgctgagttacatagtttcagtatctacccatttgaaatgggcatgcaaattcttgattcaaaactctctcttcggccatcggattggcatgcatggcgtgccagctgaaattggcgaggaactactgaccgttggacgctacgagcgcaacaatgataatgaggccgtagaatgtgcggtgtgtttatgcgagattgaagagggagaagagattagagagctgagatgtgatcatatctttcatagagtttgcttggatcaatgggttgggttattcaggcgggttacttgtcctctttgtcgtgattttctcgattcacgaagagctgttgtcgagaatgggattgagattttggtgtttaaaaggttttgttatctcgattcatcaagtgatcgtgattcatggtggttaaggtaaattctaaccatcttcataataaacatagatatatagaatttgcaaatttgtaaagctcaaatagcaacactctatatatattaagagtgcttgcttatgtatgtgcaagggaaacgtaaacaaaatcatgtgcgtgtattaacactctatataattaattaattattatccctctaatcttcaaaataagatagaatttgtgcaaaaaaaaaaaaaaaaa

SEQ ID NO: 10184 - DNA, 864 bp, Citrus sinensis
  Predicted polypeptide sequence is orthologous to G227, G242
tttttttttttttttttactcactaaccagtcctttgcatggcaacattccttaaaaccccatcaccgcccccaccactaccgttataacacgcgccacctctctgctgctcaagcgccgccatgtacgtcctcacttcctgctttatcatctcctgcatcacagccataaactctttactaaaccccactaatcccttcgacccactgtcactacttactggagccggcaccgaagcttttgcgttcactgcctgagttgactcactcactttgtttgaaacttctgaggaggaatccacaccaggaagggacagactcaatgaagtaggagggtcattagacgacgacgtcgtttccggctcgggcaccacattcacgtccacattgataccgccagatctcgccacgggtttgtatatattgtaattcgatgacaaacccggcacgcttgaatcgctgacgtcggatcccgatggactaccggggctcatataaagtcccgtggtcacgggcacactcgatcccgcactcaccgatcttttcaatttcaacggctgttgctgaatactattcccaaaatccgcatcgtatccattacaattcaaaaaaataccgttctctgtcaacatcgaagagcacttacgttttaaggtcgagttccagtgattcttaatcgcgttatcggttcggccgttgagaaggcgcgcgatggtggcccacttgttgccaaaccgagcgtgggctcgtatgatcatctcgtcttcttcgggcgtgaacgctcggtgctcgacttgaggtgacagctggttgcaccaccgtagccggcaagactttcccgatcttccgggaattgatttgctga

SEQ ID NO: 10185 - DNA, 843 bp, Citrus sinensis
  Predicted polypeptide sequence is orthologous to G227, G242
ttttttttttttttttgatttaaaaatgaaatttgtttattatcgtcgcgtaatgaacaaaaccctctcatcttcattcacgattcttctaatccatcctctctctgtacactaacaaaagtcattattaactgtttgtataataaaaagatctgattttttttcacatttgtttgtccggcgtcttctcataggtcgagtctaatttgataatcctatctgattcactaaatactctctaatcagccttgttaatcccgatacgcttaaccacagcgtttcttatggcttcagcaggcaaacagagcccgttacgttcaaccccagacatgtagtttctcacttctttccttatcatctcctgcatcactgccaaaaactccgggttgaaaaactgcttctcatatccaaactcgccctggttctgtgcctgtgcctgcacctgcaaaggttgtgttgatgccacctggttcgggttcaaaaccaagttggatccattttcggacccgggaccatgatttgagacctcacaagattcggatccgggcagcgagagactgagtgaggttggtggatccgttgttgaagatgaggtttcgacgggaacaagcgaaccggttcgaaacaaggggtggcaaactggagactgagccacaccgggtaagcttgaatcactcgaatcggatccagatggactacccgggttcaaacacaacccggaaatattattgctcggccccacactgttcgctcttttcaacggcagcgggttaatcgcatctacctgcgactcatcactcatggaagagcatttcctcttcaaagtggagttccagtggtttt

SEQ ID NO: 10186 - DNA, 352 bp, Citrus sinensis
  Predicted polypeptide sequence is orthologous to G227, G242
tttttgtctgtgatgcaagagatgattagaaacgaagtgagaaattatatggaggtggcggtgaggaacgctgggtttaagcgaacagggattaacaagattgattaagaaaattaaggaacgaaaattaaattttcgttgggataattctagactttggtaggagatttagaaattagttaaaaagatccaaaaaaaaaaagaatttgaggcttgtatagaatcagctaatgagagagagttcattttggagtagttattttgttagtgaaataatcaaaattttcccttgtggctaattttctggcttttgaaaatttcagttggaaatttggaaaaaaaaaaaaaaaaa

SEQ ID NO: 10187 - DNA, 899 bp, Citrus sinensis
  Predicted polypeptide sequence is orthologous to G2295
ttaaatctataatggaagtcataaattcagaaactgggtaaaactaaaaaatcactgaacagcccctaactgaaatcaaaagaatagtagtaaaagtacttttttaacattgtccaatctctaaagctgtcctattgtttgagaaaccccacctgtgaagaagccttttcattcttcttggctggattgatctttgagaatatcattcgatttctttgcttgggcagcactgccatcataaatgcctgatgacgtgggagacatggtcagtgaggaattccaatttatttgtccttgaagtggggtgaatggaatcgtactaccagatcccccgccgcattgaatctccatgaaacttgaatcagatggtagcttttgactaacctgataagcaggctgcaaattgacaagtgattttgcatcatttgaatggtcatgctctaactttcttgatgtggccttattcacaacgttctgatctcttttgatcatgtttagtttcctgtccacatctttgagcttatcatccattgtgctgagaatcatcttcagttgatcctctgataaactgtccataccttgatcccatgtagtaaaatctcctacacaaattttcttgcaagcccttgtagctgcatcatcaacttgcctcatcttactttcgtcgaatttagacaaggataatgttctatgttgaccatgatcaactgcactaattttcttctcgtactttctgataatactggtcaattcaccttcctttgaggtccagggctctggcttcaaagagtggcctttgacttttggaccatagatgatgatgcatacttcaacatcgcacagagttgtaaactcataagccttcttcatcaaactgttctttctctttttaaaggttg

SEQ ID NO: 10188 - DNA, 767 bp, Citrus sinensis
  Predicted polypeptide sequence is orthologous to G2344, G929
acctagcaggagcagcagaaggagagccagaaacagcctgctatagaacacagtgcctagtttctctataagatttgagttgcagattctatatgcgtgacggcctcatgacttcctctgtgcatgatatgtccgataacagtgacgctgatgagcagcggaagcatccagaatcccagttacagtcctcaacacctgcaatgggaatgtctcatccaagcatcacaactcccaatgttcaatatgcaacgcatcaagtcggggcaggccatgctatggcaccagcagcttacccctatccagatccgtactacagaagcatatttgctccctatgatgcacaaccatatcctccacagccatatggtggacaaccaatggtccatcttcagttgatgggaattcagcaagctggagttcctttgccaacagatgcagttgaggagcccgtgtttgtcaatgccaaacaatatcatggcatcttgcgacgacgacaatctcgtgcaaaagctgaatctgaaaacaaagttttaaagtctcgaaagccatacttgcatgaatctcgacatctgcatgcattaagaagagctaggggatgtgggggacggtttctcaactcaaagaaaaatgagaaccaacagaaggggatggcatcagatgacaaatcacagtccaatctcaatctcaactcagataaaaacgaaattgcgtcctcagataggcagtcctaattttttatgtatgaataaataaggtcagaggtctct

SEQ ID NO: 10189 - DNA, 786 bp, Citrus sinensis
  Predicted polypeptide sequence is orthologous to G259
tttttttttttttttttaaaaaaaaagggcttccccccaactttaattaccaaccttaataataaattttaaaaagctccatcaataactacaatatttctatcccaacaaggctgcttccttattcattcaacttaagttaaacatactttttttttttttttgaaggcttaacttcttgaaattcattggaaaagggcaaactaactgaactatcttttaaaaaaaaaatacatacattatgtattgaaaacctacttaattacttcaatcaagaactatcaagcctatcaaaagggttacccaaattaaaaagaatcattatttgcatgattgaaaaagaaaaatgttacccctttgacaaaaaatctcagcgctctccctctttctcttcctttccctccccccctcatcaacttcaaatctaactccaaacaacttcactattaaggggcccctttggtaattattaatcccatgcccatcatcatcttcatcatcatcatcattatccatatttgcgaacttacccactaaatcaagcaactccttgcacttccttttcaggctaacaagctccaaacttaagttcccattctccttcttcaaacgcttattctcatccctaagggggttgaactccaaaaacaatgacgtcaacaacaacaacctttgatcttcatcatgaaattcttgttgggttcctgctgccgttgctgcttgctgcctgtttgcccatgcttttcttcaacgtatcttgcaaaaaaaatctttccccccctttca

SEQ ID NO: 10190 - DNA, 797 bp, Citrus sinensis
  Predicted polypeptide sequence is orthologous to G259
gcacgtgggaagtctttagcaattaaatagcattgcaattgaattctcatgaattgccctcgtggagtcgtattgggtttctattgttggggctgggagttcttaactgcaattctcatcttctccaatatccttcttcatctttagattaatcttcttctcttttagctaatttccctcttcaatatttcccttctttttttttttttggtctttttaattgtttgcgatatttgaaatatggaggctacaaataatattacaataagcagctgctgtgatgacaataagggcctactggaatatgccagaaaatcaacacccccaccatttctgttgaagacttacatgctaatagaggatccggccaccgataacgtcatctcgtggaacggcgacggcaccggcttcgttgtctggcagccggccgagtttgcccgggatctactgccgacactcttcaagcacagcaacttctctagctttgttcgccagctcaatacttacggatttcgaaaagtagcaacaagcaggtgggaattttgcaaccaaatgtttagaaagggggagaaagatcttttatgcaagatacgtcgaagaaaagcatgggcaaacaggcagcaagcagcaacggcagcagcaacacaacaagaatctcatgatgaagatcaaaggtcgtcgtcgtcgacgtcatcgttgtcggagtacaacaccctaagggatgagaataagcgtttgaagaaggagaatgggaacttaagttcggagcttgtaagcatgaaaaggaagtgcaagga

SEQ ID NO: 10191 - DNA, 874 bp, Citrus sinensis
  Predicted polypeptide sequence is orthologous to G2604
ggggggtataactttgcagtatatccactctttttttctccttctttccagtctccacttcatctgcaagttgcaaaggcatggtcaaaatgggaggaagaattgatcttttctgtttttgaggcaacaaacttttaggagcttggaagagaaagacaataactgtaagatattgcaatgccagttcctcttgctccttatccaacacctccagcgccatatactcctcctgccaatggtgcacagagccagcttgtttgttctggatgtagaaatctcttgctctatccagttggagcgacttccgtatgttgtgctgtttgcaatgcagtaactgcggtgccacccccaggcacagaaatggcccagttggtctgcggaggctgccacaccttactcatgtacatacgtggagcaacaagtgtacaatgctcttgttgtcacactgttaatctagccttggaagcaaatcaggttgcacacgtcaattgtgggaactgcaggatgctgctgatgtaccaatatggagcacgatctgttaaatgtgctgtttgcaattttgtgacagcagttggggcctcaacaagtactactgagcagaagttcaatacttgaaactactgcgcattgaacttagctagtacagactcgacggcttcagttttgattacgacaatatcccaccaactatttaatgatcggaggataatccctctattcactgtatagagttactttctcttgcgtgacatctcaatcaataaagaagtttcggctagctgaatgtatgggaaagtattctgtgtgaagacttataggttgtgaatgtatttgcaaatccttggataagttaaaatttgtttttctttgcttc

SEQ ID NO: 10192 - DNA, 899 bp, Citrus sinensis
  misc_feature (876)..(876): n is a, c, g, or t
  Predicted polypeptide sequence is orthologous to G261
tttttacacacaccaaaaaaaaagtaacttaaagagggaatatctatttattgtcaaatccaaccaataatacccaaaaaaaagtaacgtaagatactaaggcattaaaagctaggaaaacaaccaaacaatatcaagtcctctctgcaggggtaagatggcccatctgttctgcaagactatttacattcctcatattccaccaaaacttgccatgatcggcaggtttgttttcattctttttgccatcacattcctttctttctgactgaacttcctgggcgtcagaagaaccaggattctcagtcaaaaattgttcccaaaacacatcattgaccccagcttgcagaggaatggtggttgcagtctctggctcctttgaaggaacaggctctgtagctgcagtcacagcaggctctgagttcatgtcaattccaggagatttagggcgagcatcaacattaagttgtatgcaagatatagctggactatctgcacaacttgtagattcatccaactccaagcttgaattaggttggaagcaactttgaccaacgtcttgaacaatattctcccaaaatgtcatggaggactccaactgctcaaacttctccatgttcgaagaagaaatatcagcactatcagcacctgctacaatttgggaagtccccatcggattgtcttcaatgttggcttcatcatagaagtaatcaattcttggcagccttctcttcctatcatgattctccaagtgcgccccgaaatttgactcaagtccgggtttttgcaaggctcgacctacaaaagacaccatcttctgctgcctctgttccatcagttgaaaacgctccctcaaaagctgcatttgcgactcanatccttgccgctcctgctcatgt

SEQ ID NO: 10193 - DNA, 844 bp, Citrus sinensis
  Predicted polypeptide sequence is orthologous to G2632
ggggacagtatctgtgtctctcttaaggttgcagagaaatacagactaaactaaaacgaatcaaagtcggtgactttcttttagaatctctatgctctgcttctcatctcacagtgcaggattaggctgtttatactattagaggattaggttgtgaatgatgccggcaaaacctgatgaaaatcggcagttagaccgtggtgctcagagtgtctcgcaatcagccatctattcccagcagccttggtggagtgggacaggaactggtgcctccttagctgaagcagcagcttctaaatcttcaagggaacaaccaaatggttctgttgtaaatggtgccacctattcacaagatgggattaatggacaagaacatgcgcatctcaaacatattccatcctcaacacctctagctatgggcgaacgccttgaacaaaattcccaaatggagctagttggtcactcaattgttttgacatcatatccatatacagatccacaacatgttggagtaattaccccctacgtgccacaagttatgattcctcctcagttatatggaatgcatcaagcaagaatgcctttgcctctcgaaatggaagaggagcctgtttatgtgaatgcaaaacagtatagaggtattttgagacgaagacagtcgcgtgctaaggctgagcttgaaaagaaagtgattaaagcgagaaagccttatcttcatgagtccagacatcaacatgcaatgagaagggctaggggttgtggaggccgttttctcaatactaagcagctcaatgacaatgctgcaaactctgcagaaaaaggtatgaattctggtgcagacggt

SEQ ID NO: 10194 - DNA, 817 bp, Citrus sinensis
  Predicted polypeptide sequence is orthologous to G2632
tagacatttcatttttgttttgttcactagaaaatggttaaagatccagactgccgttaccgttccaagttaatccatgcgactatttctaatggagtttatcaaacattatctgtacataaaaaaagaggggaggaatgacgataagcagctaaaaatgacttgcaagaagccacgaggggcttattcatctcctccctcattcacccacaatccatgcaaaagaacgaagccaagaatgatttgccggccacaagacaaccaagaaactacccttcagtatatcagtgggtcttcatcctccatattggcacgagacggcacccaccttacctgcaaaagggctcactgaatagcaagaggcctctgcgatgcctggttggaagatatgcttccccactgcttgcctgaacagtctccagtttcccctctatcacctaagtgtgaatggtatgttgatgcttgaaggccatgattctggtaaccaccattggcatttgcatgattgcgagcttcatgcatgttgtgtgcttgagacccacctacatcttgctgactagctgaagaattccaggtttcagctgagtcggatggcacgggttcagatccagatgaactgccagacagagatggcctgattcccgaacctccacccttcttttcactattacccttggaagcatcatcagttttctttgcaaaccgtcctccactaccccttgcccttctcattgcatgctggtgccgagactcgtgaaagatacggctttctaacttttattagtttcttttcaagctctgctttagcacgtgcctg

SEQ ID NO: 10195 - DNA, 749 bp, Citrus sinensis
  Predicted polypeptide sequence is orthologous to G2655
gccaaataatcgtcccaagagacggcgagccaagagcagaaagaaccaagaagagattgagaatcaaagaatgactcacattgctgttgaacgcaatagaagaaagcaaatgaatgaatatctctcggttctgcgatctctaatgcctgattcttatgttcaaaggggtgatcaagcatctataattggaggtgccattaactttgttaaggagctggagcagaggctgcaatcccttggtgccagaaaggaaatcaaagaaaattctgaaagtggctcaacattattcgctgaattttttgcatttccacaatactcaacaagttcaagtcgctctgagagtgaagcaataatgagtaatgagactcaaaattcaatagctgatattgaagtaaacatggtggagagccatgctaatctcaaaataagatcaaaacggcggccgaagcagctcttgaagcttgtttctgggctccaaagcatgcgccttacactcttgcacctcaatgttaccactgctgatgaaattgttctctattctctcagtgtcaaggtagaagatgactgtaatctaacttcaggggatgacattgcaacggccgtttatcaattgttaggtaggattcaagaagatgcttcgttgaattgatgaatcaataatttattacccactgtacttggctctattttatttttttatctttcataaaccatttgtgggtactttctttgtttttaattaggctgta

SEQ ID NO: 10196 - DNA, 779 bp, Citrus sinensis
  Predicted polypeptide sequence is orthologous to G268
ttttttttttgtcactatataaatacacaaatgaaacaattctctctttttttcaatctcttcgtctgtgcaataaatttttggtagagcatcttcgctctcttatcttggtattggagagacacgactccatgttgttaattttaattttacagtctccccaaaaacagatggaagtctggaagagaatccaattgctctaagcatgcagaaggcgcttatcggccgtcaagatccggtaacttgcatgaggtccctcggctgtctcacgcaatgtcacatgccaacccatagctttcccaatctcttgaagttcatccatgacatcaattgagtcacgaatatatacatgtccatcaggtctgagcatccggtccatctcaagcatgatagtagacatattacatcttttcctctcaacagagaaaaggccagctgcatgcaatagatcataggttcttggatacgtatcaaatggttcgcaccaatcatgcataactcctattagtccgcggtcgtaaataacaggcaaggtattgaacccactaactggaaccacattcataacccagcaatcaaaatttttgctcaattaatgctgctgcaaatcctccaaagccagctctcatgtccaatacatttctcaacttcattttcttccaatgtaaagcacgaacatagctttctattatctcattccagtactttgattcagcctcgtgccgaattcggcacgaggtagaaacgaaaagctaacttccaacccttggaaaaacctg

SEQ ID NO: 10197 - DNA, 794 bp, Citrus sinensis
  misc_feature (522)..(524): n is a, c, g, or t
  misc_feature (756)..(759): n is a, c, g, or t
  Predicted polypeptide sequence is orthologous to G274
ttataattcttaaatatcgaaggagaaagagagatagagagagagagagagagagagagagagagaggctgagagacgtgcgtcgttgtgtttgatctataaatctatataataattctacatatctgtatggtggtagcagactagttgtaagacgttgatgatttcaaatttcacagtaaaaaaagacgtgaaactctgaaacttcaatagccgtacgctgatgaatcgaggcttttcagatactcattgacacgtcttacggccgttgtggatcaagcgccgtcaatatctacggtattatttcccttttagatacatcattgctttgcttgatcagagacaaagttcagccagtgtttgattgacgattggtcaatcatggcgttgaaatcgaattcatccgacggtagaacaaggagttctatacaaatatttattgtagttgggttgtgttgtttcttttatatattgggtgcgtggcaaagaagtggatttgggaagggagatagtatagctttnnnaatttctaagagtggggcggattgcaatattgtcccaagtttaaattttgagacccatcatggtggtgaagttgagagcattaatgaatctgaatccaaacctaaagtgtttgagccttgccaccctcgctacactgattacaccccctgtcaagatcagaggcgtgcaatgactttccctagggagagcatgaattatagagagagacattgtcctcctgaggaggagaannnncattgccttattcctgcacccaaaggatatgtaac

SEQ ID NO: 10198 - DNA, 868 bp, Citrus sinensis
  Predicted polypeptide sequence is orthologous to G274
ttttttttttgaaatcaataaactgaatatttcactatttgatcaattcagtacacaataatgattataaagaacatggtttgattcttgacatcactacaagattatttgatctttgactcaattatttagggagccacacaaattacattcttgcattcccctgccaaattttatgggaaaatacttggcaaaattgattgtatagattctctgcgtcaccgaaaaacgcgtattagtaacttacacttgccaatgagaactcttcagtcctccaaccgagagcaattcaatcactactcaagatgttatcttcatttaactttcatggaccaatcagtaagatggcttaatcggatgtgctatttcctgcactgccaacccaatactgtttgacagcaatcaatatcttctcaggcatgaggggtccatcctcgtgatccatcattttggtatcccatcgcatgccttcggcaaattttctaaccttgttcagggtatcaacttcgtcccggaagatgactgccccttctggccgcaagatgcggtccatttccagaaggatgtcttctggtttacacgtgttctcatacaagctaaatacaccattagcatgaataaggtcatatgtccttggatatgtagagaatccttcacaccagtcatggtatatgccaattaggcctctctcataaatgacacctaaagtgttcttcgcagttgttggtacaacattcattacccaagattttggcgattcaagtgccgctgcaaaccccccaaggcctgcattcatgtccatcacatttcgatatcttctggtgccaatcaaactgttcatctttttgtaagcatttacatgcttttt

SEQ ID NO: 10199 - DNA, 816 bp, Citrus sinensis
  Predicted polypeptide sequence is orthologous to G274
ttttttttgcaaagcataaccgtgtttgatttgtttgtttttaataaattgctacaaaagaacatgggccaattgatggttagtagtgaacataaaccgtgtaattctcatccctttgccaaaacacttgtgcagcaaaaatgctcaggatgaatatgaaacaaatcaaatcctatcaggactcaggatccgtaaagagagagcaacgccaacttagaaccattccaaaaacaaaaatacccatttgcagctcattatgaggatgtggagtttccactggcaacccagtactgcttgacagcaactaatattttttccggaactaaaggaccatcctcatggtccaccattttggtgtcccacctcattcctccaacgatcttcttcaccttaattatctcgtctacttcatcgcgaattatgattgcaccttctggtcgcaaaatgcggtccatttctagaagaatctcctcaatattgcatttgtccttgtatagactgaaaaggccatcagcatgaataagatcataggtccttgggtaagtagagaaagcttcacaccagtcatgatagatgccgatgagtcctcgctcgtaaatgacacccagtgtgtttttatcagctaaagtgggcacaacattcataacccacaatttggaagattgaattgccgcagcaaatcctccaaacccagcattcatatccataatgttgcgataccttcctgagtcaagaagtctgttgattttcttataagcatttacgtgcttcttccatttgttactgtcctcttggtatgactcagcagaaactcca

SEQ ID NO: 10200 - DNA, 817 bp, Citrus sinensis
  Predicted polypeptide sequence is orthologous to G2747
gaggggcaaactaaaccgacttgtgataccgaaacaacacgccgagaagtacttcccgcttgactcttcgtcgaacgaaaaaggccttcttttgaacttcgaggatcggaacggcaaggcctggaggttcaggtattcgtactggaacagcagccagagctatgtgatgactaaaggctggagccgctttgtgaaggataagaagcttgatgctggcgacaccgtgtcctttcagcgcggcgttggggagctggggaaagatcgcctgtacattgattggaggcgcaggcctgatgttcatcatgttccagatcccacgacgcttgcacaaatgcagtttcaaaatcagctccgctttcagcagtcgctgcgctggggcaccaggctctactcgctcccccaatctttgtcaaattatggtcctttcagttacaatacgattcacaatccttattaccaacatcatcaacaacaacagattcttggttttggtggcaatgcgtcatcgacgatgccggtacagtattacctaaggccatcgtcagtttcacagcaaattgagggagggcatatgccgatggtgattgattctgtgcctgtcgttgttccgggcaaaactgccagctctactgcagcaaagcggctaaggctgttcggggtaaacatggactgccctacacaagatgatcaatctccagccactagtagtagttccacaaggcaagctgcagcatctgagtattcaagcaaaggaaaatcttccttgtcttttgatttggatctataatttgctatatgcattaatataatttcaagg

SEQ ID NO: 10201 - DNA, 798 bp, Citrus sinensis
  Predicted polypeptide sequence is orthologous to G2754
tttttttttttttttttacaacgtaaaaaaagagcattttcaatcatttctccgctcacaaaattgcacgtagctctttgaacctcaaggacaagacccaaagaatttgaaattcaaaaggtgaagaggttccactacgccgaatctgtggacaatgcgagcaccaaaatttcatccatagctgcctagtgtccatgcatttggcaaatctggttttacgttcaacaaatatagtgcaggtatgaaacttctaataaacatgtacaaaaggggactggctatctccggaaaatgcagccctttatagtgtccgcaggaaaagagcatttcaatcatttctctgctcccaaaaattgcacatagctcttcgatcgttagggacaagacccaaacagtttgaaattcaaaaggtgagagactccactgtgccgaatccacggaaaggatccttaactattgagagtggagagcatgcctccagttgctgttggtatcaccacttcccaaccaggtcctttaagagggtaaacagcagcattaggcttttcctcatcatccaaacaaccagcaatgaggtcggcacgatccaacaccctctccaaatcttcctcgccgatatctgtctgaatcattttgtcttcagcagtttcttcatcctggagaagtgcgagtaaatcctcttcctccaaggcatctatacaattagacttggtccgttcttgatgaaactgcccttttccaatcacaacatgctcaagcttcagcttactgaaagctcttttcaatatgcgaccctca

SEQ ID NO: 10202 - DNA, 954 bp, Citrus sinensis
  Predicted polypeptide sequence is orthologous to G2779
cttttctgtaaagcgctgagttgaagagttgctaaacttgtctaatggcattagagaatcgtaacacatctgatgatcagcctgctggagtcatgggttttttctcaaatggcagcttttttgatcatcatcaacagcctcagctttgcatgagctttgctgataacaacattcaaagtgaagccttagttgttccttccataggattgatagctgatttcagccatgataccagtaacggaaagaaggcggcggcgcatactgttgaaagttttatgaatttgtctcccactccggcttctggaagtgggttgttaagtgtaaataataagggaactggcatgcagggcttgagtggaagaaaaagaaagagaaacaatgagagagtggtggagaaaccaaaagaagtgattcatgtaagagcaaaaagaggtcaagccactgacagtcacagtttggctgaaagggtgagaagagagaaaataaatgagaggctgagatgcttacaggacttggttccaggatgctacaagacaatgggaatggcagtgatgttggatgttattattaattatgttcgatctctgcagaatcaaattgagtttctctccatgaagctttcagcagcaagtatgtactatgacttcaactcggagctggatacaacagaaacaatgccggggacaaatgaatgtgatgcacaagacatggagaggatggtgagagaagggtatggaggcccttcttacttccactctgcttggtctctttgaatgcaagacttaaatataaatttcctatgttcttgcttatcaaaagaagttgcaaattaaaccctgttgtatacaccatatatatgcttatggcaataaacaataattataaagaaaagcaaggatactgtaatctcgtattaattcccgtataaatataattaatgcatgtaaaaaaaaa

SEQ ID NO: 10203 - DNA, 735 bp, Citrus sinensis
  Predicted polypeptide sequence is orthologous to G2790
agttgtcaaatctgtttagcttaataaggcagaaacgaggcaaaaaccatgtacataacttttgacactatggaaaaagaaacagattcacttcaactgctgctgctttgtaattgttaccgctggtgctcctgctggtgatgaaacgttgctccccatggcaggtgcccagaaatcagcaccgttgctgttcgccacgtgtacggtgcacgccacggggaccagacacagtcccttgctcttcaaatcctttcttgattcttctcctccgttttctccgccctcaggttggtggtgttgcaggtacggcgagcacaggacctgaacctgatcgtgcaggaacctgatatatcccatcgcttcatgcagcactgatgctgtatctgtcttgccaaagggtgacacaagttgctgcaatgccgtgattcggtcacctagcttctctttcttggcctttgcatgggctgtagatgatgggttatcggcagcttttgtctttttgctggttctctggcttaccactggagatgttgtggtagctaaatttgagcgcggaacagattcttgggctgacccatttctctttttggtagatttggagggagtatttgcactgctgttgttaccagaagaagctgaagaagaatcactacaagttatgccagattttggagtagcagcagcagtagctgttgtttcaccatacacaacaatatcaccatcattttgcttatt

SEQ ID NO: 10204 - DNA, 904 bp, Citrus sinensis
  Predicted polypeptide sequence is orthologous to G2791
ttttttatcccatctgagaaattaaaaatttaataatagtaaaattaacaaaacctaacccgcaaattaaaataataataataacataaaataaggtttttgttcttgggattggcttctttcttgcttttttgttgtttgttagattcagtcacaaagtctacacaaatacgacgtcgtgaaggtccaacatctagtgacgccttattttcgtagactttggacgagccgcatcataaagtcggtcgacgccgttgatcaaggcttggaaacggaagcagcatctttgacggagccgtcagccccaccgttacccatagttgctgactggacagtcagcactgacatgctaggtgaggtcgggccctcaccattggactgaagcaaaggattgtggtggggattgccgttgttattgttgttgttgctggtgctgatgatggggttcctagagtgacacgtggcagtcgatatagcagttgcaagtgagatgggcattagacaaagccctttgccttgtaagtactgcatggctgaccccatatcttcttccatcagcttagccacttggtgttccgtcacagttaagctgtcgttagctgacgtcgtctgagctccgttagggttccgcccgtttgcttggatacaatcacctcctcctccctctgaggacatatcagcaacaaggggtgcgacagcagcagcaccgcccaatctactcatgctcaggaccttcacttgcagctggaggaatttgacatagtcaatgatctcatccagcatcgaagccttatctgtcttgttggcattaggtacaagttcttgaagagctttcattctctctgcaattctctctctgcgcaatctttcagctatgctgtgagggtcagtagcttgacctctc

SEQ ID NO: 10205 - DNA, 805 bp, Citrus sinensis
  Predicted polypeptide sequence is orthologous to G280
tttttttttttaaacagccgctgaacataaaatttacattcaaattacagtcacattaacctctcaacattacaactccattaccacaacactcactccctaacattaattttaaaataaaataaaataaaaataaaaccatcaattagtaaaaactaacacacctaaaaaagaacctaatttaattaactaaatcaactccccttctctttctttcttcttcgtcagcttaatttcagtcaaccagctaccggcgcaacagctggcttcactttaggtggccggcccctccctctcggcgctccggtagctggagccgaaccagaagaagccgcggctgaggcgggagccggacccggaccgggcgcagtcttagccttcttaggaggtctgccacgtggcctcccactcccacccgaactcttcttcttagacgcagccggcggcgcgaatggatctctcggcttcggcggacgtccgcgcggtctcggcggcgacaacactgtcccgggcggcaacggatccttcggcttcggcggccggccacgtcctctcttaggcggcgcgttagggtcgggcttcatgtagttgttttttaccatcacgagctctccgctctgcttcattttgtttaagtggtgagcaagtaaggtagtgtgagccggcggcagatccgggtaagccgactccatttgcttcgagatctccgccttagacgaccccgccttctcgttcaatgcttcgatagccgccatgatcatctccggatattgcgggagagtaggaggaagctgttgatgttgag

SEQ ID NO: 10206 - DNA, 390 bp, Citrus sinensis
  Predicted polypeptide sequence is orthologous to G2802
aaatgtgttttatgaaaataatatctccacaaaatataaacacatgtttgtatatttctctctctctctctctctctctctctcttttttaggcgtgtttgagtgtcttcaaaagaaagtggatgataactcataagccctttttccatgcgtagcattgagagtaaaacacaccatcagacaatttgatagtgggaataaaaagagaagaaagaggcaactcctatatatagatgaaccctaaccctaatttttgacatgcttgtatttgtttgcaggaatcatcaatgacaaacccacaagaggcagaatggttgaagtactcctccttctggcctgatcctgacaaccaggatcatcatgggtaggcgcaaaatataaaaaaaaaaa

SEQ ID NO: 10207 - DNA, 754 bp, Citrus sinensis
  Predicted polypeptide sequence is orthologous to G2826, G2838, G362
tttttttttttttttttgatgccttcagaatcactctcttaagtaaccactataaatgattacaaaaatcaatacactagtccacgccataagggggaaaaaaaaacaaatacaaaaacaaaaaaccaaagaaagaaaggacattattccatgccttgcggcatgtatattgggattattaattatttaaacatgaggaagacagtttaagatggagatcaacgcctgctatgtcttcttgatcaggcaaattaatagaaaattcggcatgcgaatgtattgcaggagcaacgtgtaagggctgaggagctgctggtgatgatgaaagcaaccatggccgcctatgataatcgctagtaaattctctttgataaatggccggtgctgacttcactgcatgtgagctgattataggtgcagcggttgctaccgacacgaagcgttgctgatcgctgtgaaactgggcgcgttttgttcttggacgcccccttctgtgtgcattttgatgccctcctagcgcttgagagttagcaaacgctcgacggcaaaattgacactcgaactttctgttttttccactagttcttgttttgtcttgaatcttatcttgctgatcacgatcagttaatggaaatccaaatagctttaatgctgcaatgggtttagtatgattagtttgtttgtctctttgcatttcgtttgatggtaatttggctgaacttgagctctctcccatgagatgtagttgggcctc

SEQ ID NO: 10208 - DNA, 811 bp, Citrus sinensis
  misc_feature (717)..(717): n is a, c, g, or t
  Predicted polypeptide sequence is orthologous to G2887
cctgaagtggtatttcttttgccacgagagaagaatatgcaaacggagctaggatgaatcgtgccactgagtttggttattggaaaactactggaaaggatagacctgttcaatacaataatgaagtagtggggatgattaagactttggtttttcacaggggtaaagccccacgtggtgatcgaacggactgggtgatgcatgagtatagaattgatgaacctggtctttctgaaagaggagttgttcaggatgcatacgtgctctgtattgtttttcagaaggatggtccaggccctaggaatggcgcccaatatggagcaccatttagagaggaagactgggaaaatgatgaggatgttgattgtgtggatgttatctcctctgctgtacttcctccaccagtgcccagccagaacagtcctgtagctgagagctcccacatccctgagaggctatgcatcggaacatctgagtcatgtctttctgatactatcccacccacttctaacatgcttccaccagtccctgttattaatgatgtatctagggaggttgctcaggatttgagcgaggacgacattcttgcaatgttggcttacttcactgaagataacaatttgatttcaaatgaaaatggtcaaattgagcagtatgataatgtccatgatggaaatattgaagcttcacctcgtttggatggcgttgatatttacnatgacttgggtgaccttgaaaatatggttggattcagtggaggtgaatatgatttcttccctgcagaaaactctaactacaatctggatggagc

SEQ ID NO: 10209 - DNA, 869 bp, Citrus sinensis
  Predicted polypeptide sequence is orthologous to G2930
tctgagtaatagttatttgcttggcacttcttggcaaaactaaagagaacatagaaaattattaacctcttatgcaaaatgaagaaattaaagtaaccatgaaatcacatcttgtctcaaaacttcgacatagtcagttgcaagcgaatccttttgcatctgtatatgtaaatggtagcaaactctcttctcacaaacacagagagttgagacactaataatgcctttttcttttgcttctaaattctgcaatagttttgagaaaacagttttttcatcattcggactgcatataatttgtatgataacatcacctttttcaacttcatgcaccaaaactgagggagcttcatgttctaattgtagattttggttgtggcgttgcttattttcaattttcgatagcatattatccttcttgagagtcagcttttctatctcattttctagctctggaatgtattcgagagctctatcaatgattgctggtgcactccttttctttttactttctgaatccggtagcaaagcaccaagagataagtaggttgcataaagcttcatccttcgtactctttccttggcattatgctcttcaattgttgtgttgtttctctcctttttcttggcactcagttgtttttcaggcaatgccttattgatgctgggggtggccacagctgaagtttctctctcagataagaagcttgattccaaccctctactactttcatggttttctaaaggcagcgatgagcagcctgcctctccatgaacccaaggatcaccagaagcttcagcaaaatgtgaaaaaatgtcatcattgcagtaattgactagattttgcagaaataattctgtgtccgtgc

SEQ ID NO: 10210 - DNA, 862 bp, Citrus sinensis
  Predicted polypeptide sequence is orthologous to G3
ggggggcaataaaagtggagtcgccttaattatttttgggttgggcatcggtatgtgtccctcagaactcacaacaagaagaaaactttgattaattatctacgaaaacgacatggaaggaggcgggtgctgcagcacttcgacttcaacgaaaagcccagagaagcggaagccaaggcagcagcggcaacaccaacagcagcaggaaaagccgtacaaggggataaggatgaggaagtggaggaagtgggtcgctgaaattagagagcctaacaagagatccagaatctggcttggttcttacaccacgcctatagccgccgcacgtgcctacgacacggccgtcttctatctccggggcccttccgctcgtcttaacttccccgaattgattttccaagaagacgatcttcgagacgtttctgccgcttcaatacgcaagaaagctaccgaagttggcgctaaggtcgacgctttacaagctgctctccatgctgctaattcagaatctgaatccaattccaattccaatttcaattctattcgattgtccgagaagcctgatttaaacaagtttccagagagttctgatgaagattgataacacaaaatacttgcaagctcacaattacctaccctagtctttccacgtttacgtactgttttattcccatcatcagtttcaactttgaaaacgtacggaatcacaaggattctgtttcatatatttatattatatataggtcgatcttcttaattagtatgtaacacgtacgactgttatttatttagttgattaattagttatggtcttaatttttgagttaactaaaaaaaaaaaaaaaaaaaaaaaaaaaaaaaa

SEQ ID NO: 10211 - DNA, 863 bp, Citrus sinensis
  Predicted polypeptide sequence is orthologous to G3055
tttttttttttttttttattttttttttttttagaaaacgtaatttgtaaattcaacacagaggtacagatgtctttcacaaagttgtgtggtcatctagcaacatcatatctgacaagcagctaaagactacaaagtacaagcttcaaatttccaaacccgaggttgaatgctactcatgctatcgaacaagaagctgagagtcggaaaataaggaagactttcttatccaagcgcagatacatgatcctaggagcatattaggagtatcaaaacattctgtcttccagacaaagctgtttcatggaagctttttcagttttcatcatatttcttcaacatgtagtaagattcaggatttcatattctattcaatatcatcaatccagtcaccatatatccgactgattttgtccggacccttccatttttcgtgagatctttgccccggcctctggactacaatagacgatctttgtgatggaactcccatatggtaaacatctgcatgaggcactgaagtaactgatgcaaccacagtatcaactggtgtttttgaaggcactcctactagctttgagtcggaaggggcagcagaagaatcattattttccgactccacaaggcctccaccaaatcggtgtaattcttgaatcccatgcgcaaaatgacatttattcccaaatgggcagtaccccgtaagctcccacttgttgcaaatcctagtcttccaattggatggcttcacattagatactccaatattatttccagcagcagcagcagctgctccccctccaccatagcctccaggccccaaacttattgccacactctccctattcttgctctgttcatcatgc

SEQ ID NO: 10212 - DNA, 791 bp, Citrus sinensis
  Predicted polypeptide sequence is orthologous to G3060
ggggattttcacaaactgtcctcccaatttttttttctccctcttcaattcgagccctagctttctctcactagggttcttgccccccaaaattttctcgcactttctctcacgctttcccgcactttctcgccgcttttttccttttcgctccgctcggtcgcgtgcttcgacttcggatcccggcggttgtttctctcgtaatggagctcggtggcggccgcaagaggggaaggcatgacggtgcctcgaatggcaatggcggctttaagaaatcaaagcaagaaatggagaactttccaactggtataggaagcgaatcgaagccatgcacaaagtttttcagtacttctgggtgccctttcggagagggatgtcacttcttgcattacgttcctggtggtttcaaagctgtctcccagatgctgaatcttggtggcacccctgctcatccaccaccacctcctagaaattcaggagccccaccatcctttccagatggctcatctcccccagctgtgaaatctcgtttgtgcaacaaatacaactcagctgaaggttgcaagtttggcgataaatgccattttgctcatggtgaatgggagcttggcaggccaactgtgccatcctatgaagatcctcgtgccatgggaggaccgatgcatggcaggatgggtggtcggcttgagcctcctccacaatcactgggagctgcagccagttttggggcctcggccactgctaagattagcattgacgctaagcttgcaggagctatcaggggcaaaatg

SEQ ID NO: 10213 - DNA, 458 bp, Citrus sinensis
  misc_feature (33)..(35): n is a, c, g, or t
  Predicted polypeptide sequence is orthologous to G3060
gggaggttgatcccaacttaaggaacattgagnnngaggggacattcgatcagatcaagcaagccagtgctatggttcgtgagttaatcataaatgttggttctggttctggacattcaatgaagtcaaattcctcttctcagtcaaacaacttcaagacgaagctctgtgagaactttgcaaaagggtcttgtaccttcggcgataggtgccactttgcacacggatctgaggaattgcgcaaatcagtgatatgaccttgcttttgtttcatcttgttccctttatgtgttaggactaatttgttgtcatagcctttgtatttggcgtgtctattaagttttgctttttcggatgcaaaaattagacatactgcagatgcacaagagttagtttctttcttattaattttttagtgtatttgttttaaaaaaaaaaaaaaaaaaaaaaaaaaaaaa

SEQ ID NO: 10214 - DNA, 647 bp, Citrus sinensis
  Predicted polypeptide sequence is orthologous to G3067
gcaatcaagctggctaaagaaacaaacacccatttgcaagatcgaccgaatcctgaaagtccacaacactcaaagaaccatagccaagtttgaagagtacagagactccattaaggcaaaggccaccaagctcccaaaaaagcacccacgctgcatagcagatggcaatgaactccttaggtttcactgcaccactttcacatgttcacttggcctaaacggatcctcaaacttgtgcaactcaataccacaatgcaatgtgtgtagtatcatcaagaatggcttcaaagttacacaagaaaccaacaaaggactccgtggaaatggcattttgacaactgcaacaagtgggaaagctcatgataaagctggagttgaagatgggagtgatgcaagggcaatgctggtgtgtagggtaattgcgggaagagtgaagaagagcatggagggtaacctagaagaatatgattcagtggctggtgccatgggcatgtactctaatttggatgaattgtatgtgtttaaccctaaggctatattgccttgtttcgttgtaatctacagtgggttctaataatttgttaagtttgttaaaacattttgttaattaagttaattacgtttcttgttaaaaaaaaaaaaaaaaa

SEQ ID NO: 10215 - DNA, 926 bp, Citrus sinensis
  Predicted polypeptide sequence is orthologous to G309
tggagccgcccgccacgaaaggtgaacctgatgttgacggagcgcgccaactcggcgagtcgcaacccgatttctcggagcgagtcgcggccgtctggcgacggcgggccaatgccggtcaacctcagcagcggaggcccgccgggacgaagagccagcgcctgtatcaacgccggccattgcaaaccatgcatcaaattgaaatcaaccacgtggacgcaatcgtggccgtcgaaagcttctaaaatggcctgattagccgtgaagtgagcgaatttcaagtaagggcaagcctcgtagaagtgatgatacagaatctcgttttcagaaaccgatccgcagatggagccgccaactcccataatccgaaagctcaacgcgtcgatgaagcaaccggcaactttaccgataccgcagctcggattaacgcgcgtcagcaagcctttcatatcctcaatcaaagagccggccactgccatctcgccacgttgcactgactcagcacacgtcatcaacatgtggaccagccttatcccggaatcttcttccatcgccgtaacaatcatcatctgctgttgctgttgttgttgctgctgagtagtagtgaaattatcggtgagatagttaccgacagccgtgtggttaacagaggggcccgctatgatatcgggtaggtcgggtagatcggacggtagagggagcgggggctggttgaactcggaaaggagagagtcaacccaagaggcgagatcagagggattgtaatggacggtatcggaagcgagttgggagatatcggcaggagagttgaccatgaccgtttcgaggcgttcaagtcgttgagctacttgacggagctccgaagaccgtactttgtacccggctcctgcaagtaacccatctatctcagcaacaggttgtttcgt

SEQ ID NO: 10216 - DNA, 705 bp, Citrus sinensis
  Predicted polypeptide sequence is orthologous to G326
gttttgggatggacattcttgtggtcagggtgctcagatatgggattttaatttgggacgattgaggggcaatgaagaatttaaacaggtagaagttgcatatggtgcaagtgattcagtatttatgatcaagaacttcaatgaactgatgaaagaaacatcccttactaatactgaaatttttggagaaatgtacccgatgaattgtcccgtcacacatgatgacatggcatcatttaataataactcaaataacccaacagccaatcaggggtctgcaacatctgagagcaacaacctaccgatagcaaggccatcatcaggttcagcttttggaaagcccaaaggctctagtagctctaaaaatatccagtttgaacagccttttcttgtgagaacaactgcagcagccaaggccaatctggagctgctagcacaaaatcgagggaatgccatgcagcgttacaaggagaagaagaaaacccgaagatatgacaagcacatacggtatgagtcaaggaaggcaagagctgatactaggaagagagtgaaaggtcgatttgttaaagctagtgatgctcctgaaggttgaacacatgctgagatagagatgtttcttgcttgctcttttgtatataactctgacattcctacggttaatgcataattcagcagtctttatttgttgaaaaaaaaaaaaaaaaa

SEQ ID NO: 10217 - DNA, 609 bp, Citrus sinensis
  Predicted polypeptide sequence is orthologous to G328
gggctactgatctcggagtggtaccggaatcaaccatgagtgacatatcgatttcacactcgaggccaccgaaagggaccattgacctcttctcaggacctccaattcaaatgccaccccagcttactcccatggacagggaggccagagtcttgagatacagggaaaaaaagaagacaagaaaattcgagaagacaatccggtatgcctcaaggaaggcctatgcggaaactagaccacgtatcaagggcaggttcgcgaagagaaccgatgctgaagttgaagttgatcaaatgttctccgcaacattgatgactgatcctggatatggcattgttccttcattctaaatccatcgatgagtcgaagaatagctctcaagactagaggtctactgtttattactaaagtactactacttgtattgtagctctcttaatataattatctgaatcaatgagatatttcttccgtatagtaattttcttgtctattcatgcaaccatgacactgctatgttgtaaatgtatgtatattcataatttttggaattaatttcatcacgattattgctttcccaaaaaaaaaaaaaaaaaaaaaaaaaaaaaa

SEQ ID NO: 10218 - DNA, 894 bp, Citrus sinensis
  misc_feature (872)..(874): n is a, c, g, or t
  Predicted polypeptide sequence is orthologous to G351
ggggatcatttccatccatttgaaatcacctctctctctctctcgaaactcaacagattcaaccacaagagtcgagaattcactaacaagaaaagaaaaaattcacgactatggctctagaagctctaaactcccctacaacaagcacccacaatcatcatccgtttagatacgaagactcatggactaaaagaaggcgctcaaaacgactccgtaccgacgagtccccacaactaccagcagcagcagcagctcccacggaagaagagtacatggctctctgtctcatcatgctcgcccgcggtaccaccaccgccaacaccgctccggccgaaagaaccccaaccctggcgccggaacagaagccgctggatcagttcccggagccgccaagtttgaaactctcttacaagtgcagtgtgtgcaacaaggctttctcttcgtaccaggcccttggtgggcacaaagccagccaccgcaagaacgctgctgacgcctcggcttctcccaacgccgcagccgccagtgacgtcaccccaccaccgtcggcaacggcgagcagcggaagcggtggtaggacccacgagtgctctatttgtcacaagtcttttcccacgggacaagctctaggaggccacaagcggtgtcactatgaaggcggcatcaacaacaacaacaacagcagcagcaataataataaaagtaataataatagcgacgttgttactagtggtagcgctagcgttggtgcaagtgcggtgacgttttcggaaggcggagggagcagcagtcaacgcggatttgacctgaacttgccggcgttgccggagttttggtcacaggaagttgagtctccgttgccggccaagaannncaagttgttgatgcactact

SEQ ID NO: 10219 - DNA, 865 bp, Citrus sinensis
  Predicted polypeptide sequence is orthologous to G351
gaggatctgaaattaagctctctctctctctctctctctcgctctttcacactcactcttggttttagattcaaaagagtaacggagatggcactggaagctctcaactctccaactacttcgacgccgccgtttcacttcgaagaagctaatcttcactgccttgagccatggaccaaacgcaagcgctcaaagcgtccacacaatcctccaactgaagaagagtatctcgcgctctgcctcgtcatgcttgcacgtggcacaacctccaccgccgtcttaactaactgcaacacgaccaccgccgcctcacagcgacagaagtctcctgctctatctactgctgcaacgacgtcgtcctctgaccagaagcttctcttcaagtgcagcgtgtgcgacaaggcgttttcttcttaccaagccttgggtggtcacaaggccagccaccgtaagggatctgggggcggcgatgaacactccgcatccactaccaccaacaccaacgcaaccgccacgaccaccggcgtaccgaacgccactggtaggacccacgagtgttccatctgtcacaagtccttccccactggccaagccttgggcggacacaaacgttgtcactacgatggcggcgagaagagcggagtgacgtcatccggatccagtagcactcacagccaagtcagccaccgtgactttgacctcaacctccctgtcttaccggagctctcccctgctttcttcgtctccggtgatgacgaggtggagagtccactgccggcgaagaagccccgtcttttcttgccccccaaaatcgaagtttaatttacttaattgccactttttttttttgtttttgggctacttt

SEQ ID NO: 10220 - DNA, 866 bp, Citrus sinensis
  Predicted polypeptide sequence is orthologous to G354
ggggcccattccacacattcaacaaaagacagttgagacagcaaaacattcgaaaaaaaaaaatctcaaatcagaagtccgtattcatccattcgctcattcatatttgagtctgtgatgaagagagatagagaaatggcagccattgacaccgcaaattgcttgatgctgctctcaaaagttggcgaaacagaccagggaaagcgtgtatttgcatgcaaaacatgcaacaaagagttcccatcgttccaagctttaggcggccacagagcaagtcacaagaagccgaagctgatgacgatggcttcatcaggggaagattttgatcaaacccagatgccaccagcttcccccaggaagcctaaaacgcacgagtgttcgatttgtggtcttgagtttgctattgggcaagcgctcggcggtcacatgaggagacacagggcagcagctgccatgggcgccgtcgccgatggattggtgactcgtcctcttttgccgctccccgttctgaagaaatccaatagttgtaaacgagttttctgcttggatttgaacttgatgcctactggggatgatttgaagttatgggtcgcttagttagttactttcattgttagtaattagtttatagcccttataaaaaaaaaatagtttatagcctttagataactggctttataatttcattttcagccctctgtatttaccgatttattgttcgatttattgttctcggattgactcatttatttgtacactgctaaaacaaaaagattcttattattgattctcatcatcagctttgctttcagttccagagataatgagatatcattttttgtacaaaaaaaaaaaaaaaaaaaaaa

SEQ ID NO: 10221 - DNA, 816 bp, Citrus sinensis
  Predicted polypeptide sequence is orthologous to G363
ttttttttttttttttgatgaaggaaattgaacaaagtatttcatacccagggtaagagaatcccttatagactctgttaaatgtaagtataggcaccaggaacagtaataggcatcgaaatacaagattattgaaattgacggtatctcttagtggcttttttagctacaacacgcataatgataggaaacataagaactcggagtttttttttctagttgttaggcagaaccaccatccttgttgaaattatgggctcctacccttgttagtttttgtacttgatgtattaataaattaagaactgacccaatagaaaagaccgtaaaaagaaaatttcaaactcagtaagaggactgatggatcagagtcggagatttaagtcaagcttgagaggctccgggggtggctctggaagttgtagattcaagcgaaagctgcctggccacatcacatctgttgcttcctctagcacgtaaggtgtccatgccattccaaaccctgtgtcggcatcattaaaccttgctccaacaccagctccgtctctgcttggcttgtgcacaagtgaatgggccctgacacctagtgatcgaaccatattagtgtggacgggcaagcccatcattgtcatcattctctgggattggtatcttttagctgcacctctctccctcttgtgggcgttctgatggcctccgagtgcctgtgaactgaaaaacttcctcatgcagaagttgcatgagaaaaccttagcggtagtcggccttgctggtgagtcaggatctctgcttgtcgagagtgaattccctcctagc

SEQ ID NO: 10222 - DNA, 862 bp, Citrus sinensis
  Predicted polypeptide sequence is orthologous to G385
ttttttttttttttaggccacacaaccagaactaatcactgaatatctatccaaaaaaacatattccaatcattttcattggtgtgagcttcaacattcaaagctctgtccaattacagctcactaaggactcatacgcttgaaacaaaagaaaagattagacaattagacgatagtccctactcgatcattggcactactctaattagcactaaacaaaagaagaaaaggtgaaatgtggagttattctaacatacatatatatcaaggtcatagttcactttcatctttgtttggcgaagtcaatgcccgaaccttttacccttgcaaggtgaggtgccttttgattgctgctctggccgaaagaaacatcacaaagcaaggattatgtaaggtgcgttcttgacttcttctcttcctaacaattttgaagcgaacaccatattactgccagtttcttctcttcctgcgcatgtcagattatctgcatgatgcattatctgtcataactgcagccttgatcctttcaacagtacacttgattagactgttcacagttgccacagatccaagagagagttttgccgttggaactgagtcaactaggatctgaaatgcaacggtaagcagagaaccaccggaaccaacctcaagaattcctcctccattaagtcctgggccatcaggaagtatggcaaaacccgacggcagaagtgcaacataatctgggtcacccccactcaagaccatattcattgccactatatcaacaggagcataaatcacatatgagccagtggaatcagtgcagctctcttgtagaaccagcatgttgctctggcttgaatttgcgctattaaca

SEQ ID NO: 10223 - DNA, 938 bp, Citrus sinensis
  Predicted polypeptide sequence is orthologous to G4
tttttttattaacaggattacatcatccggttcagtttttgatcacaaatcacacataatcatccatacagtcactagattgcaaaatgttcaaaatgcttcaagtctcataggttaaaaggaacctaaacacctatatactaagaatctactgaaagctcctgagagcaatctccacacatggcttggcttaagcatgtccaacaattaagcactgcatctccaacacagatagacaaccagtcctcaaagtaacatatagccttatttacaaaactagcaagcacattaaagtttgctcaatacactccccctagggtagaagggaagtcatcaaagctccaaaggttcatcaagtttccaccatcctgagtgttgtcaccattgaggaaggcatcgagggaggcctcccagcttccttcaggatacggcattggcaagaacttcacctgattgtcaaaagccaaaagctcatcagacagagactttccattgttatcctgaacaggcacagcattctcagagttagatttcagcttcttcatcgggtttgcaaccgcatccacaaactgagattcatcaacttcaggggtagcttccaaaacagatgagatttcaggagtctttggtgcctgttctccccagccaaagtcagaacaatcaaaggagttactgccttggtcagagttgaagtacaaaggagtatcatcagctgttggcacaaagggtttgaatcctagttctccatcattagggaaggagcccaaatatccatactgattcacttgtggtttctcctccagaatactcacattgttgtagtaatcctgatcggagttgttcaagtaatcgaagttctggttcaaacttggctgcacggggcttaggcaagctttgggaactgatttctgagagtttgccttcactgagctctttgg

SEQ ID NO: 10224 - DNA, 897 bp, Citrus sinensis
  Predicted polypeptide sequence is orthologous to G409
tttttttttatccaaataattttttttttcaaataaaagatattatttaattacattctgaacaagaagttccattcaacactcaagaaactcctacaagaacaaaaattacaaacggggcaaagccaccatttttctctttcaacagcaatcaaaatccaccaccaattttgcattagggtgccattgattgaatttatttcttattcctaacttacaattcgaacatgctttttaaaaaaaacaaagaaagacacaggcaagataaacttatataccaaggattcatgatcagaaggaccatgaccaaaaggcgtgatcttcaatggggaatccgaagttacaggaattcgtgggcgggtccgagtattcagtttcttcaagctttgggaagacgtatggaggcaacaggacattcttgctcaagctatcatcttcatcttgtgataaatcggactgttcaggttcaaaaacataagatgaatcacaagtttctaggagtgaagagtgaaccccatccgtgtaatgtgggctatccgaatcaaatatgtcacttttggctgaacttatatcttcttgcttacaagccacaactgaggctttgcatactttaccctctgaggcagcagaatcagcaacaggttctgaaatttgtggtggttcttgtttgtttactacaggcaattctgtgtttttactctctttctctttgacctgcagcttgtctgtgagcttaagaacctcagcttttagcttttctttctccttgaagagattgtcataatcggccttaaggctattatagctgttttgcaatacatcgtaatccttctcgagctgtttagtcttccaacgagccgggcggttttggaaccaaatcgcaacctgtctaggctg

SEQ ID NO: 10225 - DNA, 743 bp, Citrus sinensis
  Predicted polypeptide sequence is orthologous to G409
cccctttttttttttacccaagaaatgcattattgataccgcaccattgatagtaaccataataacaagtgagaatcagcaaattttgcactgctgagaaaagatatagaagcacatgtgccacgtgacatagcttcaggtgaggccagccaatggccatgcactaaaactgcagatacacaatttacttagtaaggccaggaccagaagagctgatcttccaaagagaatccaaaattcctagaattggttggtgggtcgtcatagcagcaggaatcttcaagttttaataagtagtgcgaagaatcaggaggatcgatcaaagatgaatggttcccatctgtgtagtgtgggctgtccgagtcgaaaacgtcactcttggctgaatttgcatcttcctgcttacaggtcaccactgggacggaggagaacaaagttttagtctcagcgcttgtgactggtttttgaggttctgccactaataacttgacggcatcaaatgtttccaaaatttccttccctttttctttaagaagcaacttatccttcagcgaaagaacctcattttgcaaaacttgcttctccttgaggaggttgtcatagtcatccttgagcttatcataaacagctttcaaagaatcgtagtccttttcaagtcgttggttcctggaccgagcacgccggttttgaaaccaaattgcaacttggcgaggctgcaacccaagctcctttgcaagttggac

SEQ ID NO: 10226 - DNA, 857 bp, Citrus sinensis
  Predicted polypeptide sequence is orthologous to G43
ccccttttccgcccccactctttggtcttaagaatgctggttttaagaatgagtaattgcccttctccgacccttactgcccaacctgagagtggacagctaatgcattccacttattgagcagggttctatggtcggtccgcgacccctggataccgaaggcgtccttggggtgatctcgtagttcctacggggtggagacgatggggtcggtccatggattttccttccttttgtcgcatttcgctcaaagggttgaagggagatagtgcatcaagctgttcgcaagggccaacttgatcctcttccccagggatcccagatgagggaaccctaagagagccgccgactccaactaccgtccatgtacgatccatactagatctgaccaaccgcccatcctacctcttctacgttcttgacagcccatctttgtctcagtagagtctttcagtggcatgtttcggtcctcttccccattacttagaaaaagttagccaccggttcaggtacaagatactatcattaccgcctggacaattagacatccaacccgtaatcgcaacgacccaattgcaagagcggagctctaccaactgagctatatccccccgagccaagtggagcatgcatgaaggagtccgacgcttcttctattctttttcttttccttggcgcagctgggccatcctggatttgaaccagagacctcgcccgtgaagtaaatcatcgcacctacggtccaaccaattgggagagaatcaacggattccttttcgggagcgattcatccttcccgaacgcagcatacaactctccgttgtactgcgctctccaagtgtgctttgtccccccct

SEQ ID NO: 10227 - DNA, 727 bp, Citrus sinensis
  Predicted polypeptide sequence is orthologous to G450
ttttgttaacccatataaccacatagcaaagcaaaatttggcaaccttagacctaatgacaccggaaaaagttaatcatttgccggaatccgacacgaagctcacgttaggcttacccggcggcggcggcgagtgtcaccggacgaaagccggcacgaagcgtggcttcttagagaccgttgatctaaacctcatgagctcaagcaacgataacaaacattgcgaagagaacgatgcaatggcctcgactacaaccccagcaaccaaggcacaagtggtggggtggccgccggtgagagcatatcggaaaaatgctatgaagggcagctgcaaatttgtaaaggtggcagttgaaggagctccatatctaagaaaagttgaccttgagatataccatagttatcaagaactcttgagtgctttagaggatatgttctcattcttgactataaggaaccacgtaaatgagagaaagattatagataatgtaaatggagttgaatatgtacctacttatgaagacaaagatggagattggatgttagttggagatgtgccatggaaaatgtttgttgaatcttgcaagcgagtaaggttgatgaaaagctcagaagcaattgggttagctccaagaacacctgcaaaaaattcaagcaagagttgaagaatgaataacagaataaggggcttattgtataaggaggcattcctggagtgacaattaatg

SEQ ID NO: 10228 - DNA, 772 bp, Citrus sinensis
  Predicted polypeptide sequence is orthologous to G450
gaaaaagaaaaccagaactactactctcgataccctctcaaaatacaaacaaaccaaccaaaaaaaaaaaaaacaagagagtgataattaattaattaagagaggagtttaaggagtgtttagtgtgtaaatttgaaagtttcattaagatgattaacttcgaagcgacggagcttcggctagggttaccgggcggtaacggcggaagcagtgaaggcggcggcggtggtgagaaagccaagaacaataacattaatggcatgaagagaggatttgcagacaccgttgttgatttgaagctaaatctttcaacaaaagagtcaggtgggattgatgtaattgagaagacgaagggcaaaagtgcttctgctactggggctacagacctttcaaagcctccggccaagtcacaagttgtgggttggccacccgttagatcattcagaaagaacatcatggccgtccaaaaggacaatgaagaaggtgataataaggctagcagcagcagcagcagcaatgtagcttttgttaaagtgagcatggatggtgccccatacttgcgcaaggttgacttgaagctatacaaaagctaccaagaactctctgatgcccttggcaaaatgttcagctctttcaccattggtaactgtgggtctcaagggatgaaggattttatgaatgagagcaaactgattgatcttttgaatggctcagattatgtacctacttatgaagacaaagatggagattggatgcttgttggtgatgtacc

SEQ ID NO: 10229 - DNA, 442 bp, Citrus sinensis
  Predicted polypeptide sequence is orthologous to G450
tttttttttctactggaaaaagattatttataaacacagacacccatttgtagtcatgaacagtcaccaatcataatacatgaaagagaaagatggggtgcataaacccataactggaacctgcgatgggactacagcattatttgttgcctactagaacgttccccttactacaagtctatactaagaacggtaagtaacactacaggaaatggagcacccaatttgagaccattaaagtcactttaacattcagaaaatatcaaccccgaaggtattttgcccgtggtgagtagcaacaggatctaactagttacgattcttgcacttctccattgctcttggggctaagccaatagcatctgaacttttcatgatccttagccttctgcaagagtccgtgaacatcctacaacaacagacaaaagaacccttagcaaag

SEQ ID NO: 10230 - DNA, 858 bp, Citrus sinensis
  Predicted polypeptide sequence is orthologous to G451
ttttttttaacagttgcatttgatgaagcagcaacattaagttcctggtatgtagtttcaattagaagggcttggaacaacacaatgacaatagatgctcagaaccatgcatcaaattgcatcttgatgtcaaacttgagtcaacagaaaaaaacttcaacttctctatatgcttaatttttgcctgtttaattttgcatgccgtctagtaattaactccccgatacccatatcgagggagaaaacaagatcatgaacccagatctgaaaattttgatcttcttccgagaacccaagcagctgatcaaagaaaagatttgcacgctccccatgagatcacaaatcttttatcttttcgtcattctctattatcatctgttaattaatatattaatttgctgtgagtcctcttgcttctgatcctttcatgattctcaatctcttgcatgacgacataaacatctcccatgggacgtctcccacaagcatccagtcgccatctttgtcttcataagtaggttcatattcagatcctttgtagccttctctttcggagtacacaccgacggtgaacttgaacatgttctctaaagcctttagaagctcagggtacccattgtaaagcttgagatcaatcttccttagatatggcgccccatccatgctcactttcacgtaaatcccagcacactcaccctcatttttcttctgctgtaagctatttttcctgtatgatctaattggtggccaccccactacttgtgccttggcaacggaggcagcttcatcggatttgtccttggtgtcgagatcgtcgggggtatccggcaacgaacgcttgttgtttcttgtttgttg

SEQ ID NO: 10231 - DNA, 588 bp, Citrus sinensis
  Predicted polypeptide sequence is orthologous to G47
ccccggaggcggccgcgatggcccacgacgtcgctttctactgcctgcggaggccgcggtcgcttgacggccttaactttccgtcaatgttgccggcaagcgtcgtccatgcagagctgtcgccgaaatccgtacagaaagcagcttcggacgctggcatgggagttgatgctcagatggttttaaacaaagacaagactgatgaaaatgaaaatgaaaatgaaaatagtggagcgacgcaagtgcttgatgagaagcagttttgggaatatgattacgagtttgaagattgtgggacatcggaagagggagagttgaacatttctgttgaagattatctcaagactcaagtcgatcattaggtcttttttctttttctttttatttttttggatagtaataaatatatagtttgagaataagatttgtaaaagaccaaatgttgtcttaaaaccaaaagtgcagtctgaaaatttttcctaatagttgaattgctggggccacttgttcgagtctttatgtgaatttcttttctcttttcacaaagacgtagaatagcagaaattctataaaaaaaaaaaaaaaaaa

SEQ ID NO: 10232 - DNA, 946 bp, Citrus sinensis
  Predicted polypeptide sequence is orthologous to G489, G714
gggatcaccagcagcaacagcagcttcagcaacaactccagtctttttgggccaatcagtaccaagaaattgaaaaggttaatgatttcaagaatcatagccttcctttagcaaggatcaagaaaatcatgaaggccgatgaggatgtgagaatgatatcagctgaggcacctgttatatttgcaagggcatgtgaaatgttcatcttggaattgacgctgcgttcctggaaccacactgaagagaacaagaggaggacactccaaaagaatgacattgcggcagcaataactaggactgatatatttgatttcttggttgacattgtgcctagggaggacctgaaagatgaagtacttgcatcaatcccgagaggaaccctgcctgttgggggacctcctgatatgccgccatattgctatatgccaactcagcatgcttcccaggttggatctgctgggatgatcatgggtaagcctgttatggaccctgcaatttacgcccaacaatctcatccctatatgggtcaacagatgtggccccagggagcagaccaacagcggtctccttcagaccattaggtgctgtagcatccagttagcgaagaaataagagggagtagggaggcccctagaaaccaaaagcccactgttgagtttcaggcaaagagaagcagaccttttgtaaataatatatgttttcgaaagagtagctaaacttttattggaccctctcgggtgatcctatttccggattactagtcagtaaccattacttaaaagttcatgtacaatttatatattttgaaagagtagctgatctcgatcgaaccctttttgtatcctgggtgctaactttttcatttatagatttagtgatggttactttagaaagatgtataaatagaaatttaagtcaaaaaaaaaaaaaaaaaaaaaaaaaaaaa

SEQ ID NO: 10233 - DNA, 967 bp, Citrus sinensis
  misc_feature (43)..(43): n is a, c, g, or t
  Predicted polypeptide sequence is orthologous to G519
tttttaaacaaaataagacacactaactgatttgatataacantttttggaacactacatttaataacttcctaaaaaaaaagaaaaattaaaacatattaacatcatcacatgccgcgtgctgtacacatgctaatgattaatgattatatgcttgcaaatccagcattaaccgtccgatcaatcagaccaatcgtccgaaagaacgtagggcttactatatcgtcaactgggccccgcaccgcacaggcacactcattgactttcgtctcgtgttgcctctttcaaggccaggccaggccaggccagcccgtctatggtccatccactcgacccaaatttaaaagggtttcggaaggtacatgaacatatcctgcaacggcgacagctgattgtttccctgaaactgagaattgaagcttatgtccatggtggaatccaagtaattatatggaaaaccaagggtgttttcccagggttgcattttaggctcgctctgcacctcgcacgtgaactccggtgacaccacgtgctccgagcaactcgagtccgtgttcagcttcggcaccgaatccgacgtgtcaaaatacatgtaatcattcactgttcccgttcctgttacggtcgacgccggattcggaatcagtgctcctcctgacgttgacttgtccatgccacttggcataaccaccggtttcttctcctccgtctccgtctccgtctccgtaaaattcggcctccgattagtgacctgctgttttttctcaatagatcccttcttgttgtatatgcgacacagcacccaatcgtccagccttaagctgttcttcttacgagccgagcgatccacgtcagctaaccgatactcgtgcataatccagttggttttctctcctttaggcgcttttccggcgtaaaaaacaagagccttcttaattccaacgggcttcggctggccaatcggctt

SEQ ID NO: 10234 - DNA, 771 bp, Citrus sinensis
  Predicted polypeptide sequence is orthologous to G519
tttttttaaaaaaatttcttctacaatcttgcacgaataagaatgccctacaattgtggtttacaaaaggattatataatacaggacctagcatactacgatgtattgaacttaaaatggcttctgcagaatcataaaaaggtcttgatagggtgataactgatccatctgatactgaacttgcgggccaaaagggtcgtcttggaagctattagtgtccatgtagttgaaattgaactgattataatcatcattcaaggcattgcctagatcattccatttgggcatactttggacctccttatcgcacgtgatctccggcgacaacacgtgctcggagcaactcgaatccgtctgcaaccggggcaccgagtccgacgtatccatatgtaataggtcattcatcattggcgcaggcgatccctgatgtggaggcattcctaatgctacctcttgacgtgaaatgttaatatttggtttccgatcctcctccagttctgggaatccaattgatttttgatcgctggggtaatgtttttccatcctccccttcttgttgtacaatcgacataatacccaatcgtcaagccttaggttgtttttggtggcgggggatctgtgaacattagcagggcgatattcatgcataatccaattagttttgattcctttaggcgcttttccagcgtagaacacaagcgccttttttatacaaagagtcttcggcttcccaatgggcttgtccgctccggtcgccttccagtatccgga

SEQ ID NO: 10235 - DNA, 480 bp, Citrus sinensis
  Predicted polypeptide sequence is orthologous to G525
gggggttgcagggcaaatttttcccatgagagacggcaagctaatcctcaggcactttgaatcaaatctgaaaaatgggctatcttgtttttagattattcagattccatccaccagatgaagaagaaatcatcaatcgtttcctgaacaagaagagacttgaccgtgatttctctgtccagccaagtaaaaagcatacagctaaatgtgtcgtgtacggatttcattccacgtacggcctttttcataaggttgaaggtcaacaactacctagtcttgattctgacaatcatgttgcagaaaatattagacaagaggtagaatatgaacaagtaacagatcatattatgacttataacgtagaaatcatgttgcagaaagcgtatgttccagttcatgggaagaattgcaactactaccaagtaaccatttggtttctggttctagaaatcatgttgcagaaaagattgaaaaaaaaaa

SEQ ID NO: 10236 - DNA, 914 bp, Citrus sinensis
  Predicted polypeptide sequence is orthologous to G559
cttttactgagaaccaacatgtaataaaagaatcgtactagctataaaagccagccacagcccactgaaaggaaacttcaacatagcgacctaagactgtaagataggagcaacctaccaaatttgaattaacaaatcacatgcagagacccacaggtgcaaaaaagtctctaaataagccatatcatgtaatatatatctcccataatccaatctccatctaaaatccaataactgcctagaaataagctatagatgtatctaaaaacactaaaggaacatggcaaaatgagcctatctgacaactgaaactgggattctggtaacaactgctcgattcattcctcaatcctttgatatagacgggttgacatctgaagtattctctttctggttgggagaaggcactgatcctctcattttaatttccccagtttgttgttgctgttcctgctgctgctgttgcagttgttgctgctgcatctgatgcaattggtgctgctggaactgctgctgctgcttctgcgagtgaatttgaagctgctggaactgctgcgcggttagaagagtatgcatagcttgattgtttgggtaaaattgctgaccagctccaaaagacggatagttcatcattggtccaccattaggcattgcttggccagtcaataccttcagatgctgaatctcctccttcagtgcatcatttagtgcatcttgcaagtggacttgttgctccatcgtttgcaaacgcagtttcaattcactattttcagcagtcagaccattagtatctctctgcaataatgtcaattgagcagacaatgaggttgcttcagtttgtaatgtctgtactttacgttcaagctcagctatgtatcgcatcttcctttcctttgacctggcagctgactgcc

SEQ ID NO: 10237 - DNA, 802 bp, Citrus sinensis
  Predicted polypeptide sequence is orthologous to G567
atgcaacatttatattgatcactgtcaatacttacaactgaaagtcaatccgactattatttgtttcccaaaatcccagcctaaaatgactattttcttctctaatgtgcagagaagattaatttgaaaagaaaagagaaaaaaaaaaaaaaaggtgcagtgcagggcatagtttattgataaatttagaccaattggtgtgttgtaaccatttttaggatgaagacaacaaggaagactgatttattctacctctgcttgttattctttgatcctgcatgcggaagtccagtgtcccagccaggcacagccccaggtggactgactctatggcctaccccctgtggcacatgctctaagccaacggcatgctgcaagggagatgtttcagtcatgtttttgccccctctatcactttgaggatttccaacagtaggaagctggatattactagggaaactgctgtccaagctctggtgatttggggtgggagtactaatacttggaattgcttggtgaaagaactggtttgggtttggttgcattggatgagtagcatttctagacgcatcgagtgggacgttgactaatggcatgccaacacctggcacatcggatctggctaaaagcaggggattcaacccagtcactcgcttaactgtttcttcagccattttcacctttgctcttaatgtctcaatatcagctttcaatattctgttattgacagcagattcatcatattttctggttcacgtcggtcagaccttttagtaacgaagaatgttcagctcgtaattga

SEQ ID NO: 10238 - DNA, 820 bp, Citrus sinensis
  Predicted polypeptide sequence is orthologous to G635
tttttttttttttttttagaggaaaatagaaaattaaaattaaaattaaatgccactcccgggatttgtttcccactctctactcttcttttgttggcctagtttccaatttacacaagggtactaaactacgaaatttaacttaatccacctcttgtatatcatcagattggccaattcacggaggcctcccgctttttgaacctagaccaatttttcattagtcattctgctctcttttgtcatggagcttccttatgacgaagccatgatgggataaaaatgtcgccaacaacccaggctttttaatttgaagcaagtgtgtccttggacactcttcccaggaattcaatgctcactgttcttaccttcttcaatcatttcgttgccatcgcctctgagtcagagtccgagaaaattttattcatttcctcaaagtatggccaacttttttggctattcccactcttgctttcctcgtatttctgaagcaaagatgaccaccgggatttgcactggcttggagttcgattaaatccctcatttgctaaatgtgttgatatttctttccagagggccattcttccctttacaacttggaatttgctatgcaattccccacgcattttaatgagtttcttcacctcctcaggtctccatttattccgtctgacacccttcgaaggctttggttgagaacttgacctctccaaggagtcattgtcgctgatttcagtaccatcttcctcaagctccgacatctgttgttcctcttgcgggatcaaaacattgttaccttttaccagactattaattggcg

SEQ ID NO: 10239 - DNA, 860 bp, Citrus sinensis
  misc_feature (10)..(12): n is a, c, g, or t
  Predicted polypeptide sequence is orthologous to G653
ggggattgtnnntggaactttttggtgttgatttacttttatggtatggttaagtgattattagctgctactaaatgctgctccttagatctctgttttcgcttactttattgttgataaacatgctgcaggcactgtgcatagagtggtttgatttttgccagccatcatccattgcttgtgaatttggcgacattacttacttggctcacacttcacgatcatgacggacaacgtagagacgagctaacatgggttctctccaacgtcttggcgcactcaatcgccaacggtccgcattcaccaagaaggggctcatgtacatgagtgcgaaaataaacggccagtccgtttgcgcactgcaatggccaaccctccaaacccagcagaagagggtgttgttggtgtgtatgttccaccggagccatcccgcagtcgtgaagacggacgcactcaaggctttctagctaaatctagcacaattcaagcttgtacatatgtagaattctctacacatttctagtacatgtaaatatctagatatttaggcaagttggtagaattctctataaccctaaagcttggcgagcctccctataaatagggcatgacatttggcatttgatcctttgagattctatgagaagaaagcgtgactcaatatatgcccttgtagtttcgaacgggccttacgacatttctcgatccaaaggaatatcatttcaagccgtctgctttcaatgtgactattgccagaatgttaagaaagtcgggaacttcttttggctgtatcatggatatcaagagttctccagctgctcacccactacggacacaaaggatgaattagatggaaactt

SEQ ID NO: 10240 - DNA, 848 bp, Citrus sinensis
  Predicted polypeptide sequence is orthologous to G653
tttttttttaaagatcattgccagaaaatggtcaatttacgaccacgggactctgtatcccataaatcagtatctctaatcaaatgaaatttgtcccaacaatgatgatccaaagaagcagagggaactgaaggtttggtagttcccctaaaaaacaacaagagggatccaaatagaaagcacacccacaagtcggagaaaacccacaccaaataagatttaaatagaaggaagaataacatgttcaagcttctggaacagaggctgctgcacgcttcattgaagcggatttgataaggtggttgtagcttcctttttccttgaacaattgggagaaatgatgtttgcaatacaagatgccttccagggctgcataatttgatgggctaatggaacaaccaccatgcgagcacttgaaacatgtcttgtgataggcctggttttccactgctaccttctccaacggatacactgttttactgcaagaagcacatttttcttgggtcccagagaacatgctggcagctttgctaggcgaccttgtcagctcaggagttaacttctcagctgactttgcaggtgactggaaattcttgttgaagttacccgactccttgaaaagctgctcaaagtgaggcttacagtaaagaacaccttccatggatgagtaattgctcagcttgagtgtgcctttgcagtgagagcacttgaagcaagacttgtgataaacaatcccatcagcagataattgctcaactggataaactgtcttctcacagaccttgcatttctgttgggtaccaataaaagacattgcttttagatctttgggaaagaaaaaaaaaaat

SEQ ID NO: 10241 - DNA, 842 bp, Citrus sinensis
  Predicted polypeptide sequence is orthologous to G666
tttgatgaaaaagactaaggatatcatatatatgatcatcacataatattgtgaattttacactatgtcctattgatgaaggagtcccatctgaaacttaattaaggccactaaatggaattataatcagtagaactgtagaagagcaattacaaaataattaataaacagatcaaaaagagtctttaatgaaagccctaaaaccagacgcagctctctcatcagaacatatcagtgtcctcatgatcatctaatttaaggtcattaagataatctttccctccttgatcatcaaaaagccacttctcaagcaatgacagctgtggcatttgatcatcatcagcaccagcactaggatctaataacaattgcttgctctcataatcttgaaaagtgctagactcaggggtcacagattgagataaatcggtagaatttgacgaatcaaaagactcaaaaccaaacaacgattcaaaagcctctgataattctatgccagtactgttgcttgcaactttgcttggagtctcttcactagaagcagattctgccccagcaatgtgattaacattgttattaattgaattctgatcagtaacacctgagttcgaagaagcacttttttgagcgtttctggtccaccctttgagcaacttagcaatgttctcagtgcttgaagcgtaagctggtgcttgaactgctggttttgtgtaggaaatgaacccattagcaggcttcaattcagacaaaatactcgctttatctggtgacaaggccgcacatagagcttgcttagccatgtgaatatcagtctgcagccttctctcccactgaccccttga

SEQ ID NO: 10242 - DNA, 425 bp, Citrus sinensis
  Predicted polypeptide sequence is orthologous to G707
ttttttttttttttaatcaaaaagaacaaataaatcataaatctgcaaagcctagaagatggcctttctataaatcttaaaaaacaacaaaaatactacctgcccacaccaatgcaagtctaggatgtgagctaaacagcaacgacgtttcagcacccaagtcaaaagtctaggctaatgtcaaatacttctctatctgaatcaaacttaagcgactaattgctacaaggaaatataacaagctaaaagaaattgattcacaaatctatctagatcatcaaactaaaaaaaacaataacaactccaaagaagagatttctacagtctacataacacaacaagctaaactggaaaataaaactagagccacataatagaataccaagcactagttgaaagcaatctatttttgtctatgccataca

SEQ ID NO: 10243 - DNA, 815 bp, Citrus sinensis
  Predicted polypeptide sequence is orthologous to G707
tttttttttttttttttgagcacccaacaacaacattagctaacctggtcaccaagtcgttacagggagttcagttcaagttccccatttggaaaaatgaaaccgaaagcaaatagttaaatttaaattgcacaaaggaatacttcaaacttcatttcagttttgtttttttgacaattcataaaggggttgacctgagtcaatacccgaaccaccacccttgccttgtgttaagaatagtctctgctcgagtccgtgactcagccccatcctcatcaccatgcaaggagtttccacgcgcggttcgttcttgactcaacacccccgaagcaaagcaaacacactgtcacacgcgcccacgtaccaaagctgtctctctctctctctctctctgttcaccacaattcacaagccacgtgattagctacaattaaccgtagccatgcacaaagcaaaacaccccatcgtgtcaagttaaaaaaccaaacaccaactccattatcgtatcagctttcacattgaagagcggccttgatcttctgaacagtgcatgatattagattgttgaccgtctccacagattctaccgtaagcttggccgtcggaagactattcaccaagatttggaaggccactgttaaaagcgagccacccactctctgtgacccaccgttgctcccattcccacttgtggggccattagccaggggccctcgtgagtctggaccatctggaacaattgcaaatccagaaggaaggagagccacgtaggcagaatcaccaccgttcatcaccacgtgcatggccgggatgtc

SEQ ID NO: 10244 - DNA, 878 bp, Citrus sinensis
  Predicted polypeptide sequence is orthologous to G707
tttttttttttttttttaaaccgaaagcaaatagttaaatttaaattgcacaaaggaatacttcaaacttcatttcagttttgtttttttgacaattcataaaggggttgacctgagtcaatacccgaaccaccacccttgccttgtgttaagaatagtctctgctcgagtccgtgactcagccccatcctcatcaccatgcaaggagtttccacgcgcggttcgttcttgactcaacacccccgaagcaaagcaaacacactgtcacacgcgcccacgtaccaaagctgtctctctctctctctctctctgttcaccacaattcacaagccacgtgattagctacaattaaccgtagccatgcacaaagcaaaacaccccatcgtgtcaagttaaaaaaccaaacaccaactccattatcgtatcagctttcacattgaagagtctttgaggagacaccggcagccaaacggaggtggcagcgcttaacacgattcctggaggctcaccgggatcgtcaacgctctttctggtcataaccctaacgtcttcatcgacattgccagcattgagcttgttccatttgtggacagttgaagcgcacaccccagcgcagaaattatcagtcattctctgtgctagcttcaacatgcttcgtcgcccacccgcagttattgcggtgtgatctctggcggagacgctggtggacatgagaatggctaggcactcgcattgtctttgaagggtggcgacccaccgttgggcgccgaagcccattccggagattatcaagggtttgtagagttggtggacttggctttcatcgtattctgcatgctcaacccatgtcacctttgagtagccattaggcatgtctt

SEQ ID NO: 10245 - DNA, 893 bp, Citrus sinensis
  Predicted polypeptide sequence is orthologous to G8
cagagttatattgattgtttagcaaatgagtcagaaaacaagtctttggtgtatatgaatcactatttgaatcatacaacgaatttgaagaccactgctgttattgttgcctatagacactcaacatcgcgggatgaaaataggctatggtggtgcctgcggcagtttcatctgataataaaactgagaggtgttgggggcagtagtattagttgaagtgaaacagagattgacgtctgacggattgagaggttttgatgagagaacggcagcggagggaggggcagccgaaaatgggaatcctgatgatgctgcactagataacagtgacgctggggtaccactgacctggccatgcatttgccatgcccagttaggaaggccttgtggaggacccaattcgattctcttctctgttgctttttcctcagtagtaagaagaccaggatatgcaccattccagaaaattggatgctctgacgtcctcataagtcctttggaagctgaatcccccacagctgcagtagtagagttctcggtccttgaagtccttccaccatgggcaccataagggccagaaagaaactgggaatgcccttcatttgccttgggaccactgccaaacgatgaagatatccccaagttcaaatcaagattatgatcaccaccttcattactgccctcagtaatcatctccccttcatatgtgcttggctcaaagttggtgactgcctccctgccattgcatttgatagctgccttgtcataagcccttgcagcttctacttcgctgtcgaatagcccaagataaatatactttttgccgaggaattgccccatacgtgcttcccaacggccgcatttgtgtagtgtcacccctctatattttgagc

SEQ ID NO: 10246 - DNA, 811 bp, Citrus sinensis
  Predicted polypeptide sequence is orthologous to G811
tttttttttttttttacataaaaacatatttattcactctctccccttaaggtcggccaaaaaaaataatagtaataataaaacattaaaaaatattaattaccaaaaagcgaaaagaaaaaaaaaattaatacaaagatagaatccaagataaatctcgtgataagcaaactaaaaaccgcctcctagcaatgaaaatggataaggtggcgttggcggacgagactctacccccgttaccatttctccaaaataacccatttgcccattagtactagtaccactactagtactattcctcgccgtcgccggaatcgccgataccggactaggaatggcggcgcagccataactattcatcacttgcctgctttgccctaataaccagccagaacttgaaacactgtaattattgttattattattactatctggtgacggagatgactgacaaaagttgttactgttgttattattactattatcgaacccagaatctggggaagaagatgagatcacccctatgttgcccacttcttcttcttcagattttatcgagctcgaagctgccatgcccgaagaagaagaattagaaggctgctgctgctgctgtgatgacgacgagatcatcaagcgtctctttttgtccccaagataataattattcctgttggtggtgctttctttttccatgatgatgcgaggaagcaagtcgggatcttcaacgactttgtaaagaaacgccatcatttgttcagggcgcctctctgttgcttccagtctcttgttcatgccctgaagctcttcatct

SEQ ID NO: 10247 - DNA, 877 bp, Citrus sinensis
  Predicted polypeptide sequence is orthologous to G843
tttttttttttttttttgctgagaaagagaatcttaattttgattctttgaatacaggttgctgaagtgactaataaactatcgctacctacttcgaatctatgactatgactagattttatctgagtcttcaggaacccaaataaaaaataaaaaatttactgtacaactttggtgtacatgcattttgaaaaatgaaagggagatggaattaggatgtgtgtgatcatgcttgagcaattccctttctcacaagcatatcatataccctatcaactttatttggttcaaccttgaacaggttatgagcatccgattttttgctaacgttgcccttgtatatctctaccgataagatctccaacattttgagatagtgtgccggtagtatcttaatctcaccacagagtcgtttctcagtttcagaaagtagatcggcacccacaaacccagagatgtcccagtcttccagggagctagcaatagttgagtatgaatcattgccaaatggctgcaaactggtggaacccctcacaactccacgagggctgacctcaacttcacccttgagactatttggcctctgcaacactttaccacttggaccagcctggccactttccttcactctctggccattttcctcagcttccttcttcctcttctgttcgagaaatctatgtgcctcagaggatgtacgacaaccagcagcttgtgcttcctgaagttcttgtattcttttgacaatccgatgttcttcaataacactcttcagcaactcctcatgatcttcttttgagtggaaccgcatgaagaccttgtatcgctgatatatgtccctctcttcgggtgagagattcctctcaaatggatcagg

SEQ ID NO: 10248 - DNA, 879 bp, Citrus sinensis
  misc_feature (31)..(33): n is a, c, g, or t
  Predicted polypeptide sequence is orthologous to G865
gcggggactctcccattcaatcctcaacttnnntgtctacaggtctgttaacaaaaccaaacaaaacaattactttttccgttgtatgtaataaaatccaataaaaaaattattgcattacattagagtttatagaagtgcttattgtaactgcaaaaaagtggatcatcgaaggcatggaaagcggccacttccactggaagcatcaccggaggagaaagagaaagaacaagacaacaacttccctgcttggactactcatgaatcagacatgtctgccatggtttccgctcttacacaagtaattggcaccactaccaccgacgccgacgccgacccctcgccggcagccgttaaagaagaatcctccgataacccacttcaacaaactcaaactcaagatcaagatcaagaaggtacaaggaggagacattacagaggagtaagacaaagaccttggggcaaatgggcagccgaaattagagaccctaaaaaggcagcacgagtatggctaggtacatttgagactgctgaagatgcagccatggcttatgataaagctgccctcaaattcaaaggcaccaaagctaagcttaatttccctgaaagagttcagggtactactgagtttgtgtatttagattcatcatcatcaagctctgcctttcatcatcatcatgagtcggtgatgcctgctcctcctcctaggcctacatcaatgcaccatggtgcatacccggacttgcttcaatatgctcaaattctatcttctgatgatgctacttttaattactatacgtccaatctctttaatccacaatcatcatcttgttcttcttctactccttcgacgttgtcatcatctaccacctcattgga

SEQ ID NO: 10249 - DNA, 795 bp, Citrus sinensis
  Predicted polypeptide sequence is orthologous to G896
tttttttttttttttttccgcagatcagtccaataatggagatatatatcctttaatcagcatctcttattctgaaaacagaggaagggagaaaagagaaccaaaagtacaaatattggacaaatatatgattgaatcaaagttttcacaataactgtacacattgacagaacatacttcaaacaaattacgagctcctggataagaatattgcttttactagtagttatagggagaaaggctttgtatagacatcgaacggttcattggcagtcaactgaggttcctgtctgaacccgccactaagactccctcctgtcaaaagcatggtgaccagagatgttacaagaccaccggcacctgaaagctcactaccactgtctgtgttacggatggtagatctcattgagttcagcatgctcccatatgtagctccatgtccacgctcaatagcttggatgaaagaataagtcatcgcaccggttgatgtgatctttgacagagccgaagtgtcagcagatgtttgattatcatcacagccgctaaatgaaatagcctccccaccacttgtccctttccacattcctgatcgagggcggtgatcctcccatatatatttcccctgcctgtccatcctacagagaaatggtaagtctaacacggttccactatgacaagcatctataattgcatgaagcctggccccacgaggaagaggccggactagagttgcgttgatctcatcatcgacaatcattccttgggtttcgaaatccactggacaaagagtttcat

SEQ ID NO: 10250 - DNA, 305 bp, Citrus sinensis
  Predicted polypeptide sequence is orthologous to G896
ctgcgtggcctcctcctccggtttatgggaggaaaaaagcattgctatgtggagtaacatataatgatacaaattacatgcttactggtagcataaatgatgttaagagtatgtggtttcttttggttcgcatgttagggtttcctagtgactgcgtagtcatcttgacaggtataaattgctctctactaagttaataagctagcattattgcatttttttggctaataccttccgttaaagctcgatcttatttttcagttaccaatatatggcattcaattacttttaaaaaaaaaaaaaaa

SEQ ID NO: 10251 - DNA, 801 bp, Citrus sinensis
  Predicted polypeptide sequence is orthologous to G921
ttttttaaaagggaaaaattctcctttttcgttaattttgaagttccatgtaatgtacattaatattgcaaggtatggtctccagactctaatcctccattaaagtaactaaagcaaagcaaaaatacagaagttgatacaaattaacatccataatctgtgttgatcctggctagctagagtgaccatctttgtgttcgggcctgatcagcaaatcttcctgaaatagctgctgcaagtgctgctgtaaaattaggatctttggtcaaattagaagccatttgttggaccaaaatctgatggattgctggagcttcaatttgttgaactgatgattttttggcatcatcaaacaaaaatccaggttgaatcatatcaagagttgcagtagggcttgctgatagcatcgatgacgccgcagaaacatgaataggatttccaatagttgcaacatggctagggctcaatgataattcagcttttgaatccgtaggctgaggatgattatgctctccttcataagttgccactaaaattgatggatcctcagcacttctttgcaccttcttctttacgggacagcttggggcgaaagaacacttgaagtaagccctaggtgatgggttgtctcttgtaaccttttggccatactttctccattgatacccatccttcacaatcagggttgaatttgaatcactggctctcacataaaacctagaaacttttgccttggtgttgttatcctttggccttttgcatgactcttcgtcagtactagtgctggactcagtagcgtgt

SEQ ID NO: 10252 - DNA, 657 bp, Citrus sinensis
  Predicted polypeptide sequence is orthologous to G927
ctattattattcaagatatcaaagagtcataaacccagaaagcataaatagcttaagcacgccacactaaaacgtttttcagaatcataaacacattatctggactcccacacttttattttcagacttaccaaaaccaacccttctatgttccaatcctttatttaactacttatacagtgcatcaaggtattggcatctctaaccattccaagctgcctgcttggaatggcaaagacgatcaccttcacgcagatgagccaagaatgatttgcctaaaccaaacggtaggtggacaatccacagagctactccatttggtcgaaggtaaggatgggtttggtgcagcaccaatcccaaatggtttacatgctatcaaactttaaggttgcagcagttatcagctgctgcaacccactggctgggcatgacaatgccacgcccggtgtccataatgcccgaaaaagagtggacaggtggcccgagatgattgatccgaaagtgaccaaactctccccttgagtacatgctagtcacctccgaccctgaaagattagggccactgccatttgtttcttttggagaactcaaagttccactctcagactgcaggacttcggaactctgagagccagtgggctgaagcaattgctgaat

SEQ ID NO: 10253 - DNA, 836 bp, Citrus sinensis
  misc_feature (812)..(812): n is a, c, g, or t
  Predicted polypeptide sequence is orthologous to G938
gggaatcaggaagaagctttgtctaggaaactgtatcctgatagctgccttccagcgtctactggaggaagtggttctttcatcattagtgatatcagtgattatgatgttgaaggagtagacaatgaaaggaatgttgaagtagaggagattaaaccactcgaagccaatcttttcaacatgggtgctatgggatcaagagatcggtttatgatgcctccatccttggttcctcgaatcaagggagaggttttcgagacccactcagaatccattcagaagaggaggccgtcggctgatgagccacatatgacgatggatcaaaagatttatacctgtgagtttccccagtgtccctacaatgactaccaccatggctttctggacaggacttcgagaaacaatcaccagctgaattgcccataccgcaataacggttctcaagggtgtgtaatgccaaactttcaaattaacaatgaccaacctgcagtgttctctctaccatttgctcagtctactcacccgaagccaataacttcagtgaagaaccagactcaacctcagtataatgtatcgggacttggacttcctgatgatggacaaaagatgatttctgatttgatgtccttctatgatactaatcttcagcctaataagagcatgagtcaggggtgtctgaacattacggaagatcgaaatcagcagccagagcagcagaaatttcaacttcagctggatgatagcttctataaccaaggcataggtgttatgaaggggggcaacatgcccatgaacaaccctgttttctcctncactgaagttcattttgatcaatg

SEQ ID NO: 10254 - DNA, 805 bp, Citrus sinensis
  Predicted polypeptide sequence is orthologous to G938
gatcaatcttctcttctttctgtgcttactttcttctcgggaaagttgaacttaactttaccaattttcccgggaaatttgtgaggattccacctgttatatatggtaaaaagggttgcgatactcgggcaactttgaagttttaatacagttgttgctcatagatagtcaagggaaggaggtggttttattgcttgaagtttttttggttatagtcctattagattagcgagagacttgcaaatttggagtttctgtgggtgttaacgctgtgggaatgatgatgagttttgatgagatggggttttgtggtgacatgaacttcttctctgctcctctgggagatgcagatatggccgtccaaccatctgaaccggaggctaccgtggaggatgattatactgatgaagagatggatgttgatgagcttgagaggaggatgtggaaggacaaaatgcgtatcaaacggctgaaagaacaaagcaggggcaaggagggaattgacatggccaagcagcgtcagtcgcaagagcaggcaaggaggaagaagatgtcgagggctcaagatgggatcttgaaatacatgttaaaaatgatggaagtttgtaaagctcaaggttttgtctatgggattattccagagaaaggaaagcctgtgactggggcatctgacaatctccgtgagtggtggaaggataaggttaggtttgatcgtaatggtccggctgctataactaagtaccaagctgataattcagtccctggcaagaatgagggcattaacgcaattggtccaccccgcata

SEQ ID NO: 10255 - DNA, 901 bp, Citrus sinensis
  Predicted polypeptide sequence is orthologous to G938
tggaaaacaagcatacattaaaaatatgtgtacataatgtatatgtatatatatgtatacaactactggccaataccaaccatagcaacaagaaactgttcctaaacttcaatagcagcagtgaatattgggttgtggttcctaccagttacttattgcccatcttcaatactgcaatgaaagcaaaacctaaaaaccctagacttgaaacataccaaatttagaaggaagaagtctcgcacctttggagcagaactcataacagcaaccttcttccaatgatgtacagcgtttttttctagtctgctagagaccacataaaatgtaagcactttatatgacaggtccatttccttcttcaaaggtaccacagggatacatcttgcttcggaatagaatccatggcgtaatcaactgatgccatgttgaatggagagttaaatctaaagtcagtgataccgtcgctgggattggcatcatatggggaatcaaatgctttgcactgatcaaaacgaatttcagccgaggagaaaacagagttgttcattggcatgttagattgccctggcatgttgcgtcccatcacagctccttggttataaaagctatcatccatttgaagttgaaatttccgctgctcctgctgctgattctgatctccaatagcattaagattccctgaattcaagctcttgttctgctgatgattagtatcatagaaggacatcagatcggtgatcatcttttgtccatcatcaggaagttcaagtcctgaaatattgaattgcgattgagtctggttcttcggtggagttgccggcttaggttgagttggttgaccaaaaggtcgagagaaagccacagtttggtcattgttaacttgaaagtttggcatcccgaa

SEQ ID NO: 10256 - DNA, 879 bp, Citrus sinensis
  Predicted polypeptide sequence is orthologous to G938
tttatgggaattttaccacctttcttattagcccatctcacaacctgcttcgcttctaatttctacagctaaaagaaaaatacaactaacagctttttaacataattaaagttttaccacatcataagccaataccgaagccataaaatatgcccagaggatgaggatgagaagctggcattgtttttagaaccagactgagctatcatgcttcggcatggtatccacccctgctgcttgaaaatcctctttataatcgaaggatcctaagtcgaatggagactcaaacatcaagctaaaattgttgttgctgccgctgctgttgttctcgaatggagaattcataatcttaaaccgatcaaattgattttcctctcgtgggaacatcagatgattgttatcatgcatgttggatccttcgaacaagttcccatccattacagctccttgaccatggtaatactcctgctgatgctgagctcttggctgaagagtattttgaccttctgtcacaacggcgttgttactgggattcacattcctgtttccttggatattgttatcatagatcgacatgagctcactaatcattttttgaccatcttctggaactccaagtcctgatatatcaaaggaaggttgcacagaattaaacgttggacctgctggcttggactgggcaaatgtttgagggaaaataactggtttcacttcattaacatgaaaatcagacccagcaaactctgaagcaccacttttatatgggcatgtcagctggtgattgtcccttgaagtcctgtcacaatagcccagacgaggatcactgtaaggacactgaaggtattcacatgtgtaaatatgttgatccatcttcatgct

SEQ ID NO: 10257 - DNA, 902 bp, Citrus sinensis
  Predicted polypeptide sequence is orthologous to G938
accttccctctaaaagcaggaccagatcaaattcatcaaacctttttctctctcctctgttttctctctctaaaagtgggtttcaattttaaaaaaagaaaaagaaaaagaaaaagaaggcttcttggattactctatcgaacaaacaaataattatccggagttcacacttgatctacttttgcttcaatttttttttttaaaattttgaattgcaagtgtgtggatttgagaatctgaaagaggaaggaagagaattgaagtgggtttgatttaagttttgaatcggagttgttttctgttggcttatagtgaatgggaatctttgaggaaatgggattttgtgggaaccttgagttcttctcgtctccccatggggaaggagaggcgtttctggaacatgaacatgagacggcggctgaagaggattatagtgatgaagaactggatgttgatgagcttgaaaggaggatgtggagagatcggatgctcctgaagaagcttaaagaacagagcaagagtaaggaatgtgttgacagtgctaagcagcgtcaatcccaggagcaggcgcggaggaagaagatgtctcgggcacaagatggaatcctgaaatatatgctgaaaatgatggaagtttgtaaggctcagggttttgtgtatggaataattcctgagaagggaaagcctgtgagtggagcatctgacaatcttcgagcttggtggaaggaaaaagtcagattcgatcgaaatggccctgccgctattgccaagtatcaggctgatcatgcaatccctggaaagaatgaagattgtggttctgtggtgtctacacctcactccttgcaagagcttcaggacactactcttggatctcttttgtcggctcttatgcagcactgtga

SEQ ID NO: 10258 - DNA, 475 bp, Citrus sinensis
  Predicted polypeptide sequence is orthologous to G961
ttttttttttgaaaagaaaaaaagggggaagaaaatgttagctattaattaagttattagaagctatttcatttgcaaaatggatgttttctatatgaattgactgatttgtttctttgcttgagttggtcatttgttgggaatttatattactcaaattgacaattgaaagaaaaaagtctcaaatttttagacggggattcgcaaatagttaattctcttattaggtgcatcaaagaagcccatttttaaagttaatttcttctggaaaacattcattgtattgtgaggcacgggcaactgctgtggaaacaaagtaaaaggtacccagtaggtgcttctaaatagtgtatgttgtatgatcctcatgaatggagcattttttaaaaccaattctaaatattgtttaaaactttcaggattactggttctttattgatgcgagagagaatattgtcttggagaaattcattta

SEQ ID NO: 10259 - DNA, 871 bp, Citrus sinensis
  Predicted polypeptide sequence is orthologous to G979
ttttttttttttttaccacgaatcaacataaagttggattttctttgaaaagaaaaaaactttaaaaaaaaaaaagattaaaaaagaaaaacccatatttcatccacccaccaacaacaaactcaaaacaaacacccaacaattttgtttgctctccaaccctcttaatgatcaccactacttcaaacactataattacaagaaaccgaggttgttgttgaagaaaatggcgatgatgcatttgaagaagtcgaaaaagccgacagcagcctcgagacaactaacttattaccattttcctcttcctcctcctccatgttccccgtgtaattgtcgttgccctcgggattattttcattaatgtacttcgacacttcttctgcttccacatcgaaaatgaagtctatgttgtcctcgaacaaccccgtgttatcgaacaagtccggcagctcaccggcgtttcccattgggatatcgggaaacgttagcggagttaaccctaccgccgtgtccaggcagaaactccatgttagctcgtgctcgtcagtagccgccatagcacaactcgcgtccatcatgcatgaaggaagttgtgtgttttgctgaagtacttgctgatgaggtgaaactatttcttcttgttgcggtaataatgctggctgcgtttgctgctgctgttgttgttctggttgtggttgttcaacttcgacttctgcttcggtttcttcggattccatcgaggaattcggaagagggaaaattcctttcttcttcaattgatcaatgtaatgactaaagtcaaagttggtcactgcatttgcacctctatactcaattgccgccatgtcaaatgctgccgctgcttcctctt

SEQ ID NO: 10260 - DNA, 838 bp, Citrus sinensis
  Predicted polypeptide sequence is orthologous to G993
gaactctctcagcctcttcttacttttacagaaacctcatattatctacaacacaaattgtttggatcctctaaaatattgactccaaacaatctgactacaccgatatttggaacttggctctgcatctcttcaaagcctgacccatttccattttgttgcagcttgcaatcaatgaacaactttgaattagacccaacaatagatctccaaaagctcaccgtatctccagctttcacgcctttctccttaacgaatctgctccacccctttgtcaacacataactctggctgctactccaataacagtacctcaacctccaaactttctgagtactatcctcaaaattcagcaacacccccttggaagcaatttctgagcttaatgcaaagtgcttctcagcttgttgctttggtatcaccattctgtttaacttccccacatcacttggtgtaagcactttctcaaaaaggaattcaacaggtgtttcctgaaaacaatttgacccaaacaggtcactaaaacctgagctattattataacaactaatgccgacacatgcataattttgtttgctttgctcaagctcatgcttataagtatgcttccttagcatatcaacaatctcagccttagaatgtgagctcaagaaaatcttctccatgtaatcgtcttcgtcatcagtctccaatgaagttctgaaatttgtgattgcattttggccccggaacctcagtgctgcagtgtcatagaccctagcagcttcctcttcttcaatgaatgtaccaagccacacacgttgatgcttctcatatatttgtgcaccccatctgccat

SEQ ID NO: 10261 - DNA, 904 bp, Citrus sinensis
  Predicted polypeptide sequence is orthologous to G993
tttttaattataaaattttgttacaacctaatttcagctttcttcagcttttgtcacttgtaatttacaattcaaccttttccttttcctttgcaacttgcaactactggcaccacccttccccagtctcttctttccccttaaaactcctcaaaattccaaaaactccaaaaggaaaaaagaaaagaaaaattacaacaagaaataagattacaaaaaagaagaaaaaagaaaaaagatgttacgaagctccaatcattctttgttttttgctgcactctagagacaagagctccatttctctaagccttttgccgtcgttattattattaatgttgcacccaatcttatcgacaccaacaagaccattcccaggaattttgaaaatgttgaccccaaatagcctcatcatctggaccggctcgaccgggttctcgaccggtcctgttctggctttccaatcaatgtaaagctgcctatccccaccggtcgatctgtgaaagctaacaatgtcaccggctttcaaattcttctccttgacgaaccggctccaccctttggtcaaaacgtagctttgactgctgttccagtaggagtacctaaacctccaaactttgccggtgacatcctcaaagttcaagagcagtcccttggaagtgcttccgctctgtaaagggaagtgcttctccgcgtgctgcttgggtatcacgagccggttcagcttccccacgtcacttggggtaacggccttttcaaaaagctggtcacgcgctttaaggacccggtctgaaccgaaggcagtggcaacaccatcaccttccccgtgtttgattacacgcttgccgttggcatcgaggccgtagtttcttttgctctgctcgagctcgtcgttgtaagtgtgctt

SEQ ID NO: 10262 - DNA, 767 bp, Picea glauca
  misc_feature (4)..(6): n is a, c, g, or t
  misc_feature (51)..(59): n is a, c, g, or t
  misc_feature (735)..(736): n is a, c, g, or t
  misc_feature (746)..(760): n is a, c, g, or t
  Predicted polypeptide sequence is orthologous to G1033
ttcnnnttatgtgcattgtcaacccatagttcacatacaaagcgggacatnnnnnnnnngacaccccgtgccacatcaatacatattagtctcatgttaccactcccccaattacgcatgcttcaaaagattagatacctcatagcatttggctaaacccccccacacatgcacagaggcatccgttacaatattatgcccatgaaaccccacaaaactgttctcttaattaaacaaatccagcaatttctggacacacctactcctcttcagcctcaccatcgccattagaattagcctcttcatcattaacatcaccatcagcatcagattttgctacctcatcctcaccaccatcactggatttagctgcctcatccttgagatcttgttggtatttagacatggctttctcatactctgcctttagttcagcagccttttccaggtatggcttcttgtcctcgtctgacatagccttccatttcaagcccccttccttgccaacctgggcagcacccttgacgtcaggattagtctccttataggtcttcctaaaatcatccatgaaaacaaaaaatgctgtagcaggcttcttcggttgattaggatccctagctttcttctccctcgtgcgctttgtcggcttctcatctgcagactttttctttgcctttttcgcttcgggtggcttctgggcatctgcgtgtttggtttctttggaggcatcaaagnnagaccggatnnnnnnnnnnnnnnngcaatcg

SEQ ID NO: 10263 - DNA, 936 bp, Picea glauca
  misc_feature (779)..(783): n is a, c, g, or t
  misc_feature (887)..(893): n is a, c, g, or t
  misc_feature (898)..(911): n is a, c, g, or t
  misc_feature (926)..(928): n is a, c, g, or t
  misc_feature (931)..(935): n is a, c, g, or t
  Predicted polypeptide sequence is orthologous to G1033
ggggaaaattctctctctcctcgcctcctttgttattatctcaacattgatcggccatttttctatagaggaaaatagcaaagcgagatttgtgtagctgcgtttcgactctgttacagacgaacgttcgaggttccaagcccacgcgttgctaaagcaagtgctttcttcgatgaagggaggcaaagcaaaaaacgaggcgtctagtacgctgaagaaagttgaggagaagcctattggtaagcgaaagactgcagcaaaggaatcgaaggtaagtagtaggcaggagaaaaaagggcgcaaggcggccaaggatcccaacaagccaaagagacctgcgagtgccttctttgtatttatggaggacttcaggaaaacttacaaggaaaagaatcctaatgtcaagtctgtatccgttgttggcaaagctggaggcgacaaatggaaatcaatgtcagaagcggataaggccccatatgttgccaaggctggcaaaaggaaaaccgagtatgaaaagaacatggcagcatacaacaacaaacaaactagcactgcaggtgacagtgctgaagagtcagacaaatctaagtctgaggtaaatgacgaggatgacgaagaaagtggagaggatgatgatgcagagtaaatttctcaaaggcttcgcctgaaatggctttgtatcagtgccattaagttggaagaatttgtaacttgactaattagctgctggtagatgattttgttatttcctaccttttgtagggggcatatatgaaggnnnnntgatcgctggaagtgtatgcctcgggtagttccatatgtgtagttattcatgaacatgttattgactgctgtgatcatgttattaatgtttttaaaacatggtnnnnnnntcgtnnnnnnnnnnnnnnattatacaactttcnnntgnnnnnt

SEQ ID NO: 10264 - DNA, 879 bp, Picea glauca
  misc_feature (12)..(14): n is a, c, g, or t
  misc_feature (49)..(58): n is a, c, g, or t
  misc_feature (782)..(783): n is a, c, g, or t
  misc_feature (789)..(789): n is a, c, g, or t
  misc_feature (791)..(794): n is a, c, g, or t
  misc_feature (797)..(798): n is a, c, g, or t
  misc_feature (839)..(842): n is a, c, g, or t
  misc_feature (849)..(850): n is a, c, g, or t
  misc_feature (866)..(871): n is a, c, g, or t
  misc_feature (877)..(877): n is a, c, g, or t
  Predicted polypeptide sequence is orthologous to G1078
gagtagatctgnnntagataggatctctcgaagtgaaaatactatctannnnnnnnnnactcttactttggagtgaacctaagatagttactgtttgttacaaggattaaatcaaaattgactatcacctatagtgatctagaatgaaacattggcacctagaaaaaggaaagcccttatttctatgatggatggcttcatataataaaaagatttagcaactactttaacatctgacagaagaatgatcattcaaagacttggtcaggttatagatatcctcaaaggaacgcacacaaacacttgaaaaactactcattgcttggaatagacctggaaggcctgtttgaatattatttaaagtcattgctctggttcctctagcggattttgaatagttggccttttcatctgctaaccgccttttatatccctcaatctctgttcttttttctgccaaaggatctgtgggatcccgttcaacttgagactctgatggagaatctgtcctagaaggtagtgaatacgaactataatacttcttttcaatattgcgcagagcaatcattttcttttgcagctctctagaaaggttttctgctttcttcttgcacttttgttcatcagcttgctgcctcactatagcatgaacaacagagataaagcttttgatggactcagaagcaaccttgtctggcagtctttcaagtgcttgttgccattcctcacaaagagtataaataggtgggcggttccctcgatcccactctgcttcattcccnngctgangnnnnctnngacgtgcccacccacacagagcacgaatataatcccgttgnnnntttatcnngctacagaagctgtcnnnnnntgctgnaa

SEQ ID NO: 10265 - DNA, 602 bp, Picea glauca
  Predicted polypeptide sequence is orthologous to G1113
tttttttttttttttttaacaccaaaagataagcttccacaacaaagataaaatgtttgtaactcaattttgaccagcctgagagcggaacgaaagtagctgacacaaacagtatttattctatcgactgaattttcccacacacagttatcatgatagatttagattaacgattaacacacttataataattgatactggccttcacctatgctgctatacaaggtgggagacctgcagagaggacaactgtacctttgataatcgatccacttgtccaaacattccatatgaaaaacatgcccacatttaggtaggtaacggattcgatcagttgcccggaaatcagttagacaaacagcacatgtaatatgtttccggcgatctgctagtaaactgccgtattcaacaacggccggcagattctcacggatggtctgtagagggctgttaacggggcagtaagaagaaatatcaggaatggttgtggtgaaaggaactatgggccaaagtgggagagggttacgagaaggatattgacgagcttcttcaagaatcccagttctatgaagagggctcagaatccaattcagtaaacgcct

SEQ ID NO: 10266 - DNA, 790 bp, Picea glauca
  Predicted polypeptide sequence is orthologous to G1134, G2555
ttttttttttttttttttccaaatatgaggttgcataggatttgcctaacagtattacataatgcacatattacatttctgagtaggctcgccgctctaatgccagatcaagacataatatatatacccaatcactctcaagggagagggcctgtgccaagaagaatacatatttgagaacaatactaattatcttttacatcaggtgcttgggaatgtatattcacaataagattatgttttgtatgcacaatctggtttatgtgtgcaggtacacttgtctcgattgtccgtaagttcctggacctgcttctgaagggacttgacatattcaacagcctcatctaacatgtcggcaatatttactgtttgcttgtcactgtttggcacgagttcctgcagttttctcattctttcactgattcgtgtccttcgcaccctttcagcaatgctccgtctctgctgattataattccatcccatctgggacttactctgctgattataattccatcccatctgggacttactctgctgaatttgatagctttagctttttcaagtttgtattagtatggccctaccggagcaccaggaccgcggtctgttcggtctgttcgacaagaagaaggaagaggagggaaagcatgaagacgagacccaaaatgaggctcaggctgaggccgcttcttattatccaactcctcctcagcatggagtagagcactgccagggtcacggtcacgaggggcaacttacgcctgaggaagctgagcaaaataaacacgcg

SEQ ID NO: 10267 - DNA, 868 bp, Picea glauca
  misc_feature (791)..(791): n is a, c, g, or t
  misc_feature (795)..(802): n is a, c, g, or t
  misc_feature (806)..(809): n is a, c, g, or t
  misc_feature (815)..(816): n is a, c, g, or t
  misc_feature (820)..(826): n is a, c, g, or t
  misc_feature (830)..(830): n is a, c, g, or t
  misc_feature (832)..(832): n is a, c, g, or t
  misc_feature (843)..(843): n is a, c, g, or t
  misc_feature (847)..(847): n is a, c, g, or t
  misc_feature (856)..(863): n is a, c, g, or t
  Predicted polypeptide sequence is orthologous to G1140
acagtgtgagaaaacaactcaatataatttaatcaattatataatatattcactttttctttctattattttttataggaagaaaactattaaaatagaaatatgaagcagctcttgaaatttgatcacggaagatcacgatgcaacattctcaaagttcagagtgcgaagataaccctagctgcaaggaagtaacagaatcctcagggtctttgacaggagagttatgtaatttgaaattaaacgcatatgtatttatagattcagatgactggggatcctgattttccaatggctcaatgaacaaagattcgcatccatcgttattttccacaagactgccatatccttcatttagctgtccacggagttttgtattgtcctctatcatttgtattcccttttgttgaagttcttttatctccttaacatgatgctcaaccttttgtgatcgaatgcttgtcaatcccatttcaagttcttcttctagttgttgcaagtcttttaaagataacccttcaagttccttcccatgcatttttctcaaattccgactagtatcttcaaattgttgttttatccttttaagatctttactcttgaactcaagagttgttggttgtccatcattttgaattgtgctatgatacaaaatgtatttgtccaatatcaccttcatactggagctcgagtagtcgtacagcttcccagttgaagaaaaaacgaccagggctacatcagcttcacatagaatcgatagctcccgagcttttttgaacagccccctacgnctcnnnnnnnncgtnnnntgcctnntcgnnnnnnnagcncntcttttaattnctanttgctcgcnnnnnnnntcact

SEQ ID NO: 10268 - DNA, 897 bp, Picea glauca
  misc_feature (818)..(823): n is a, c, g, or t
  misc_feature (825)..(825): n is a, c, g, or t
  misc_feature (829)..(829): n is a, c, g, or t
  misc_feature (836)..(842): n is a, c, g, or t
  misc_feature (845)..(851): n is a, c, g, or t
  misc_feature (857)..(857): n is a, c, g, or t
  misc_feature (877)..(878): n is a, c, g, or t
  misc_feature (885)..(887): n is a, c, g, or t
  misc_feature (889)..(895): n is a, c, g, or t
  Predicted polypeptide sequence is orthologous to G1140
tagaaattaagagaatagctaacgcttcggccaggcaggtcacgttctcgaagaggcgcagggggttgttcaaaaaagctcaagagttatcgattctatgtgaagcagatgtagccctcgtcgttttttcttcgactgggaagctgtacgactactcgagctccagcatgaagatgatgctggacaagtatattttatacccaagctcaaatcggaaggatggacaaccaaatcttgagattgagagtcatgatctcaaaaggataaaacaacaaattgaagatattagtcaaactctgagaaatatacatggcgaggaacttgaaaaattatctctaaaagacttgcaacaactagaagaacaacttgaagccgggttaagtaaggttcgatcacaaaagggtgaaaatattcttaaggagataaatgagcttcaacaaaagggaatacgaataatagaggagaattcgaaactgcgtcgagagatcaaggaagcagaacgcggccatgtggaaaataatgatacagaggagtctttcttcattgaaccatcggaaaatcaggatccccagtcatctgaatctataactaatgcttttactttcaaattacataaatcggccatcaaagactatgaggattctgatacttccttgcagctggggttatcttcgcagtcaaaattttgagacgcttgcaaacgtcatcgtctgtgatcaactttcaaacactgcttcatatttctatttttacaattttctgatattttaacaattttcaaacaaattcgatcagggaaaaattaagcatggacgatnnnnnnangagntaccatnnnnnnntannnnnnnagatanacgaacgagtaacacaggtnntagacgnnntnnnnnnntc

SEQ ID NO: 10269 - DNA, 841 bp, Picea glauca
  misc_feature (801)..(802): n is a, c, g, or t
  Predicted polypeptide sequence is orthologous to G1140
gctaatcgagagagatcttgcctgttgttgtaatctcagattggaatgacatggcccgagagaaaatagagatgaagagaatagctaacgcttcggcgaggcagatgacgttctcgaagaggcggagggggttgttcaaaaaagctgaggagctatcgattctatgtgcagcagatgtagccctcgtcgttttttcttccactgggaagctgtacaactactcgagctccagtatggaggtgatattggacaagtacgttttgtatccgagcacaattcaaaaggatggacaacaaattctcgagttcgagagtcaagatcccaaaaggataaaacaacaatttgaagatgctagtcaagatttgagggaggaacttgaaggattaactttaaaagatttagaaaaactagaagaacaatttgaaatggagttgagttgtattcgatcacaaaagatgtcatttttgtggtgttgtaaggtggaacatctttctaagaagataaatgagcttcaacaaaaggtaatacaaatgatagaggagaatacaaaactccgtggacagctaaatgaaggagatggcagtcttgtggaaaataatgatggatgctaatctttcttcattcagtcattggaaaatcagaccccccgtcatctgaatctataactacttatgcctatcaaagactgatgattatgttacttccttgcagctagggtatgcaattatacttatcaaattctgtttttatttatttttaattggtgttatcttaacattttatgttatggtatttttttgnntaaatttgattatataaatttggacgaaattttattttt

SEQ ID NO: 10270 - DNA, 689 bp, Picea glauca
  Predicted polypeptide sequence is orthologous to G1146
ttttttttttttttttttaaaagcaccaaggccagaagatcattatctgccttcttgtacgaattattcattcacatgatattctaacaagagataacacaacataaaaccaaacaataggttttcatgggcactcagatccgaaggacctcaatgcttctgatttggttattctgtcaaggatcagttctgtagaagccgtactttgaagtgtgatgaatgaagtttattttatacaaatgacagtctagaatacatgattcatagaatacattagcagtagaacataactctcttcacattttccttaatagctggcaaaggccgaacagcagcagctccagtcccaggacgagtgctacgggtacccgaactactagcagctacactcctaccaggaagtccactatgtaaagatccgctgtctgacgtttcaggctccatgtagaagcgagctcgaaatgcggccagatgcgcataatatgcgggaggaacgattgaaacagagcgtgtacaccgagcatatctgaataccagcatgactgcaaaggtagaaatcaaactcagttggatgacaaatcttggaatcaactacagtgcctggcaatatgttaccacttctatcaacactagtcctgtcacgatgattatgagcaaataaccttgtgtgatgacgtttttgaactact

SEQ ID NO: 10271 - DNA, 938 bp, Picea glauca
  misc_feature (802)..(808): n is a, c, g, or t
  misc_feature (813)..(813): n is a, c, g, or t
  misc_feature (815)..(815): n is a, c, g, or t
  misc_feature (817)..(822): n is a, c, g, or t
  misc_feature (869)..(870): n is a, c, g, or t
  misc_feature (872)..(872): n is a, c, g, or t
  misc_feature (878)..(880): n is a, c, g, or t
  misc_feature (899)..(900): n is a, c, g, or t
  misc_feature (918)..(924): n is a, c, g, or t
  misc_feature (928)..(934): n is a, c, g, or t
  Predicted polypeptide sequence is orthologous to G1146
cggtggaagaaacactgtcttagttgatgcactgtcaaggaggatacctttggttagtgacaaacctacaataatctttggagcagatgtaacccatccacaccctggagaggattcaagtccatcaatagccgctgttgtagcatctcaagattggcctgaagtcaccaaatatgcaggcttagtttgtgctcaggcacatcgtcaagaacttattcaggatctttataaagtctggcaggatcctgtgcgagggactgcaactggaggcatgataaaggaattgttgatttccttccgaaggaatacagggcacaagcccgagcgaataatattttacagagatggagtaagcgagggccagttttatcaagttctgttgtacgagttagatgctatacgcaaggcctgtgcatctcttgagccaaattatcagcctccggtgacttttgtggtggttcaaaagcgtcaccataccagactcttcgcaaacaaccatcaagatcgaaatgctacagataggagtggaaacattttgccaggcactgtagttgattccaaaatttgccatcccacagaatttgacttttacctctgcagccatgctggtattcagggaactagcagacctgcccattatcatgttctttgggatgaaaacaaattcacagctgatggattgcagtccttaactaacaatctctgttacacatatgcaaggtgtacacgctcagtttctatagttccaccagcgtattatgcccatctggctgcatttcgggctcggttttatatggagccnnnnnnntcagntngnnnnnncttatctagtggtgttcctggtagtcgcatgactgctgctagttcanntnctcggnnnactcgtgtacctgcgggannaactgttcggcctttgcnnnnnnngaannnnnnngtca

SEQ ID NO: 10272 - DNA, 717 bp, Picea glauca
  Predicted polypeptide sequence is orthologous to G1150
ttttttttttttttttttcaagccatttatttttatttatgtggacgattttgatacaaaatgtgtaagaaaccatcgtctatgcctgaaaatgtaaatcgacttaaaattacaacggcacttggaatcagaagctgcagaagggaaaatcacccaagcacaagcctgaaggtaatacttttctttatctcaaactattccggaattgccttctgtatatatatggactctgttgcatttccaggaccttcagagtattgagacaaaaatgaggaatggtagcacaaaaagcctacaaaaccttttcagatctcactaagattacaaaacttatgcatgctttcacccttgtttaagctattcaagtttgttcataagaaactcagtcttctttcaacagtaaaacattaatttcttgacattttcattgagcttcggaaggggtagaggttctattgaaggacaaagtctggaacgcccacttctattagaagaaacctcagaagcactagtcgatctgcttgaagacgtctcggaaatgctcccagacttatccaaatacagacgagctcgatatgctgcaagatgagcatagtatgcaggaggcaccaaagagactggctttgtgcacctgacaaaggtgtagcagagattgttgataagttgctgcagctcatcagatagaaaatgatttttcatcccacaacacatgataat

SEQ ID NO: 10273 - DNA, 871 bp, Picea glauca
  Predicted polypeptide sequence is orthologous to G1198, G1806, G558
ttttttttttttttttttaactcatgatcaagtcatattcatcattgaacaaggggagtccagatttttgtcgtatttctcacaaacaggggaagtatggcttccctgcatttgagattgaaatattacttgattaatgcagccaaacaaatgatatatactaatagaccaaaaactgtcgacctggctattatgttacatttgaaaccacagtaaaaagttacttgttcatggaggtccaaccttgtgtgattatactggataattacttctaaatactttacattcctatctagctaattcaaagaaataaagcctcctcagctttgaaaatcctatcttcgatgtcaagggaatagttagcttaatttcttcaatatgaaaggctgagaattatcccaggcacaactggattctcaaaaggtgatttcagacttcctcccacaacaatgatgcaacaagatttcaatcattgtacaagagttatttcaaaataccaaggggcaaagccaaacctctacacggttcgaagcatgtattctgtatttcatcttcaatacatccaccctcgcaacccttcatcaactccatcctgtcagagatggagaagccctttcaggattgctcatagacgtggctatgcccattgcctagggctgcaacatgatacagatcaaagcacataatttctaacaatttaatctctggggcgagcaagccatagagagctaagggcacgcagtctcactcccggtccgtttcgtctcaactaccaggtaaacaactgctactgcatgggattcgaacaccaggcggcctgtgtgtcggcgaagcaattactcaaagacaataacggctaagagcgcgttgt

SEQ ID NO: 10274 - DNA, 882 bp, Picea glauca
  misc_feature (778)..(779): n is a, c, g, or t
  misc_feature (786)..(786): n is a, c, g, or t
  misc_feature (843)..(845): n is a, c, g, or t
  misc_feature (853)..(879): n is a, c, g, or t
  Predicted polypeptide sequence is orthologous to G1198, G1806, G558
tttgtcgtatttctcacaaacaggggaagtatggcttccctgcattggagattgaaatcttacttgattaatgcagccaaacaaatgatatatactaatagaccaaaaactgtcgacctggctattatgttacatttgaaaccacagtaaaaagttacttgttcatggaggtccaaccttgtgtgattatactggataattacttctaaatactttacattcctatctagctaattcaaagaaataaagcctcctcagctttgaaaatcctatcttcgatgtcaagggaatagttagcttaatttcttcaatatgaaaggctgagaattatcccaggcacaactggattctcaaaaggtgatttcagacttcctcccacaacaatgatgcaacaagatttcaatcattgtacaagagttatttcaaaataccaaggggcaaagccaaacctctacacggttcgaagcatgtattctgtatttcatcttcaatacatccaccctcgcaacccttcatcaactccatcctgtcagagatggagaagccctttcaggattgctcatagacgtggctatgcccattgcctagggctgcaacatgatacagatcaaagcacataatttctaacaatttaatctctggggcgagcaagccatagagagctaagggcacgcagacgagaaaagtaatcactgatagcaagaagcgcacgtgctgcttggcgagttgtcaatatcctatgcatttgctgtagtgtctgttgccgcaaattgtcagnntggtgancaaaaccttcaagggtacctaacttgcccattgccattgccatttgtcccatatagnnngctacatnnnnnnnnnnnnnnnnnnnnnnnnnnnacc

SEQ ID NO: 10275 - DNA, 890 bp, Picea glauca
  misc_feature (22)..(26): n is a, c, g, or t
  misc_feature (812)..(817): n is a, c, g, or t
  misc_feature (854)..(858): n is a, c, g, or t
  misc_feature (864)..(866): n is a, c, g, or t
  misc_feature (872)..(873): n is a, c, g, or t
  misc_feature (875)..(886): n is a, c, g, or t
  Predicted polypeptide sequence is orthologous to G1198, G1806, G558
tactctaatattcacatctcannnnnattatttcaatttcttcttgaatcttgaccctgttttttcccatcatttatcttcctacatttgacctgaagctgccaagcatggacagagtcaaacttccatacacacccttctattcaatcttcttttgcaaattaaccgacacccaataattacatatacagtccaggcaattaagagataaaaatatcaaactaagaaaagttacaacattgaatatttgtacaatcttcagaaagctatacattttattctcaagaaagatgatgcaatgaggttctctaaagacatctttctttataatctatattctggctcacctgcttagcttccttccatgtaagttacaacactcgatgcttgaaagagttgtaacaaatgtgacatcaggctgttcttggctcttggtaaatggcctttaaacgaagtatagatgactagttttgtcagctcaagcagttcaccaatagacttcaagtcatctcagggattaagcttactcacgaggacgagcagcccataaagaactaagggcccgtaatctggtaaagtaatcccccatagcaaggagacctcgagctgcttgacgggttgtaaggatgcgttgcatctgctgcagagcttgttgacggagattgtcggcctgatgtacaaagctctcaagcatcccgagctttcccattgccattgccatttgccccatgtagttggcgacatttggtgcacccaatgaacctgctgccagagtgtcaaccagggactgctgaagtgcttccatgccttgnnnnnntgcatcctctgcctgctgtgatgacagtttcaagctnnnnnctgcgnnngattgnngnnnnnnnnnnnnctca

SEQ ID NO: 10276 - DNA, 2880 bp, Picea glauca
  Predicted polypeptide sequence is orthologous to G1272
atggagtccaaggatatttcaggcccgggtgatggagcagggccttcttttagtcagtccgttgaagttctgccatcctctcccccaaatcctcctcaaatggaaacacagctcgggccttcttccagtgaggctgttgaagttctgccacccccaccccccctgcctcctcaaatggcacagaaactactagaggttcctcgtgttgttctaactaaacgacctggacacggtcgagctggtagacctgttaagttactctgtaatcacttcagagtaagcttttcaaatctccaggattcatttcactacgatgtcaaaatcactgcttctgaacgtgttgaacgtgggggtaaagcacaagatgttgttagtaagatattgtgcaggaaagttatggataaagtcaaagaagtatatggtgccactggactggatggcaaagattttgcttacgatggagagaacagtttgtttaccgttgggcctctcagaaacaacaacattgaatgcattattgttattgatgacgaaaggagctcaagaaggcctattaaagatgaaagccccagccagattgagcagtcaaaaaagagaagagaagatagaggggagaaattcaaggtagaaattacatttgctgcaaagatctcaatgaaagctctgcaggctgttattcaaggggaggtttctgataaagcccaagatgcattgagggttttagatatagttctgagacaacatgcctctaggaagggctatttgttggtgaggcaaagtttctttcattggagttttgctcctttggttgaactaggaggaggtgttaccggatgcaggggctatcatatcagcttcaggcctacacagagtgggctttctcttaatatggatgtgtcaacaacgatgctcatcaaagaaagtgctgtcattgattttttgttggcaaatcaaagtgtcgrcaatccatggaagattaattggtccaaggcaaagcaagtgctgaaaggagtacgcattacaacagtacacactaatatggagtttaagatctttggtttaagtgaaaaaccgtgcaaagaacaactcttttcaatgagagtaagaagccaaggcagccaagaagagcctcctcaaacagtggatgtgacggtgcatgattactttgtaaatacaaaacaaactcctttgcagttttcagcggatcttccatgcttggatgtagggagaaaaaaacgacccaattatcttccgatagagctttgcaaaatcctcccgggacagagatatactaaggctctttctactcaacaacgcacaycacttgtggagcaatccagacaaaagccagatgaacgaatgcaagtgttactgaaggcaatggatgtgaataattacaattctgacccattattgaaggcctgcaatatcaatgttgataaacagttggtacgtttagatggtcgagttcttgacccacccacgcttaagtttgggaagatggaagaggctccaaggaatggtcgttggaattttaacaacaagactatggttcgggcgtctaaaattggagactgggcaattgcatgtttcaattcaagaattcgttcaaatgaaataacgaacatggcacgtgagcttcagcaatgttgtggcagaagaggattggtaatggccgactgtttgggggttttggaagaaagtccgcaagacagaaatagaaaccctattgacagggttgaaaggatgctaagtcagatgaagtctagacttccaaagccgcctcaatttctgctctgcatcttaccagagaggaagaacagtgatctttatgggccttggaagaggaagttcctggcagacttgggggtcattaatcaatgtattgcccctccgaatatgaggaaagtcaatgatcaatatttaacaaatgtggctttgaaaataaatgcgaaggttggtggcctcaactctgttttatctgtggaatttgcgcataagatacctaagatatccacgaaaccaacaattattattgggatggatgtttcacacggttctccaggacatgcagattcaccttcaatttcagcggtcgtctcatcgagagaatggcccttgatttcaagatatagagcttcagtgagaactcaatcacccaaggttgagatgattgaagctttgtacaaaccgttgccctcaggaaaggatgcgggcatgatcagtgagctacttgtggacttctaccaatcatgcaatccgccacctaatgtagaaagaaaaccgcagcaaatgattgtcttcagagatggagtcagtgaatcacaatttgaccaggtcctgaatgttgagttacaagctatatataaggcatgcaatcacatagaggctggttataagcctaaagtcacactgattattgcacagaagaatcatcacacaaagctattccctagtggtggtccaggcaatgtgcagccagggactattgtagatgcccagatttgtcatcctagaaattttgatttttacttgtgtcctcaggccggcccaataggaacatcacggcctactcattatcatgtcttactggatgagaatgattttagtgtggatgatcttcagattcttgtccacgctctatcttatgtgtatcaaagaagtacgaccgcaatctcttcagttgcaccaataaactatgcgcatctagctgcgagccagatgcaacaattcctcaaggcagaggatctttcagaaacagcttcgcgatctggaaaaggggaagggtcagttgcatctggaggaggaggatacactgcccctgtacctgaactccctgtgctgcaccgaaatgtttgcaacaccatgtttttctgctga

SEQ ID NO: 10277 - DNA, 831 bp, Picea glauca
  misc_feature (729)..(732): n is a, c, g, or t
  misc_feature (787)..(787): n is a, c, g, or t
  misc_feature (790)..(794): n is a, c, g, or t
  misc_feature (797)..(805): n is a, c, g, or t
  misc_feature (812)..(821): n is a, c, g, or t
  misc_feature (823)..(823): n is a, c, g, or t
  Predicted polypeptide sequence is orthologous to G1272
agagaatggcccttgatatccaggtatagagcttcagtgagaactcaatcacctaaggttgagatgattgaggctctgcacaaaccatcggcatcaggaaaaaaagatgctggcatgatcaatgagctacttatagatttctacaaaacctgcaatcctccaccaaacgtagaaagaaaaccacaacaaatgatcattttcagagatggagtcagtgaatcgcaatttgaccaggtcttgaatgttgagttacaagctatatttaaggcatgtaatgatatagaggctgattataagcccaaagttaccttgattgttgcacagaagaatcatcatacaaagctgttcccaactggcccaggcaatgtgcagccagggactattgtagatgctcaaatttgtcatcctagaaactttgatttctacttgtgtcctcaagctgggccaataggaacttcacggcctactcattaccatgtattacttgatgagaataattttactgtggatgatcttcagattttggtccatgcattatcttatgtgtatcaaaggagtacaacggcaatctcttcagttgctccaatcaattatgcacatctagctgcgagccagatgcagcaattcctgaaggcagacgagttttcggatacagcttcccgatcaggaagaggtgaagggtcagttgcatctggaggaggacatgtccctgaactccctgctctgcannnnaacgtttgccacacgatgttcttctgctgagtcttactcagaattttttctgccntcnnnnnatnnnnnnnnnattcatnnnnnnnnnnanactccgct

SEQ ID NO: 10278 - DNA, 515 bp, Picea glauca
  Predicted polypeptide sequence is orthologous to G1275
ttttttttttttttttttgtgaaattaaaaaaaatatatactaagaaggagaaccgtacaacaagtacggatagtacaacatacaaactttctgaaattagcagcaaaattgtagatcgggttgtgaagttgatgtgcagaggtattaacaacaacagggccgagtgattggaggctgccaccgaacagctgaagcaaccatcaggacgtggaacagctgatgtaacggctatgtgtgattgggcttcaaagaagtggacgtagccaccagctagagaagccacgggctgcagccaccaaggtatatctaccgccacagcccgtcgagcaaataacgctcatgcaggggtcgagggcagtcgtacgcatggagaaagggaagtgacgacgcagggggtgcagccaacagttggtgggcagagtattgaagtagtggctcctgtcgcagccacaaggagaacccagccagccaccaggttgtaggatccacctgtacatcgtcagtagatctggcc

SEQ ID NO: 10279 - DNA, 438 bp, Picea glauca
  misc_feature (4)..(10): n is a, c, g, or t
  Predicted polypeptide sequence is orthologous to G1335
gctnnnnnnnacttcaattgcacgcgctacctacacaaatatatagaaacttaaggcgggtaaggcggtaacggcccataagtcgcgccggagccaggcggctgaccgccatcgccatagccgttcttagtactaaccaggcggcgaaccatatccgctataatccttccagaatagtactcgccatcgccacctctaccagaacccgagcgccggtagccactcccggtagcacgggaagcctcgctgtgaccatatacatgaccagtacagagaaacagactcaaagcaagcacaaatatgcagagaaatttagtcatgctggtcgccattatctacgatattgagcctcgggaagagctagattaggcgctgatgagatggagagaagtaacctttcatatttatagacggaaatttcttccgtcgcctcgtgcc

SEQ ID NO: 10280 - DNA, 853 bp, Picea glauca
  misc_feature (10)..(13): n is a, c, g, or t
  misc_feature (34)..(39): n is a, c, g, or t
  misc_feature (766)..(766): n is a, c, g, or t
  misc_feature (802)..(808): n is a, c, g, or t
  misc_feature (812)..(815): n is a, c, g, or t
  misc_feature (826)..(826): n is a, c, g, or t
  misc_feature (828)..(828): n is a, c, g, or t
  misc_feature (830)..(831): n is a, c, g, or t
  misc_feature (833)..(833): n is a, c, g, or t
  misc_feature (842)..(848): n is a, c, g, or t
  Predicted polypeptide sequence is orthologous to G1335
cgaaacttcnnnnagttcaaaataaagtagtatnnnnnngacaaaaaccattcacagcgggagtgccgttacacatgatataactttaatcaccgcctcacagtaaaaaaaggagtgtttatccctagccaatagtagcaaaaatagatcgtctaccgccaatttatggcctgactcgtagagagtctacagataaatagttcaagtaccttacattacaatagaaccatacaaacataactaagcctgctaatttcaaaacaagataaaacatttaagccagacataccaaaatcggagcaggcttacaacgacaaaagccacaaaccacgaaatcttagagaaggcgtgagtagcggcagcgggcacaacattcaaaacgctgaaggataacaggaataagcaggaagagaaggcttccgaaatgcctaaccttcacggttagggcagtctcgggcaaagtgaccaaagtcaccacactgataacagctgccgccgcctgcgccgccgccgccaccaccgttgccaccaccgccgccaccgctagtgcagtctctggcaaagtgaccagattctcctggacgaacgctccatcaggccccgtaacatctagggccttggttcttccgccattctcatgctcgaccgtgtattcgacggcctctccctcagccagcgatcgaaacccgttggaatgaatcgaagtctgatgtacaaacaggtcctcgctgccatcatcaggggttatgaaaccataacccttagncgaatcgaaccatttcaccttgccagatctctttcnnnnnnncatnnnncgaatccctcnangnncnaccaacaannnnnnntcgtg

SEQ ID NO: 10281 - DNA, 709 bp, Picea glauca
  misc_feature (579)..(581): n is a, c, g, or t
  misc_feature (615)..(619): n is a, c, g, or t
  misc_feature (647)..(647): n is a, c, g, or t
  misc_feature (649)..(651): n is a, c, g, or t
  misc_feature (675)..(675): n is a, c, g, or t
  misc_feature (687)..(688): n is a, c, g, or t
  misc_feature (704)..(708): n is a, c, g, or t
  Predicted polypeptide sequence is orthologous to G1364, G481, G482, G485
tatgtccatgctaatcaagtttgaaacaaatccattaatcgaaatagatagacgtgaatatttttgtacgaaactttacaaaaataactccatgtcattgcctacaatgacaacaattcacatatacagcaatataaaaatcacaacttcaatgtacaatatcacaactgcctttcattgcatcaagttaaaagctttgcccaataacacaaaattaagttaaatgaatggttcttcgattgatccttcacaaaactagccattaaatttgattggctacatactaatcagcaattcatgacctctcatgcatcattacagatcattgccctgcattgtcaccatatgatgctgcatctgagactgcatatttggaatcccttgatgtacatttgactctttctttccgtattggtctactccagattttgaagatcccttattgtcaccctccgcctctctgtacatgagcaagtaaaccttcaagggctcgatataatcttcaaaccctagcgtgctcattgcccagagcaagtcgtcaccgttgattgttttcctcttctctcgctggcatttgtnnntggcctcgctggtgatgaagctgataaactccgnnnnncattcctgcacggtttccttggcgtctntnnngatcttgccgttggccggcagcgncttcttcatganncggctaatgttggcgnnnnnc

SEQ ID NO: 10282 - DNA, 854 bp, Picea glauca
  misc_feature (39)..(45): n is a, c, g, or t
  misc_feature (762)..(768): n is a, c, g, or t
  misc_feature (773)..(773): n is a, c, g, or t
  misc_feature (795)..(797): n is a, c, g, or t
  misc_feature (813)..(814): n is a, c, g, or t
  misc_feature (818)..(818): n is a, c, g, or t
  misc_feature (821)..(822): n is a, c, g, or t
  misc_feature (826)..(827): n is a, c, g, or t
  misc_feature (829)..(837): n is a, c, g, or t
  Predicted polypeptide sequence is orthologous to G1364, G481, G482, G485
acctactgaatacagacatttgtgaaacaacatttcctnnnnnnnttctcagcacagttagtaacaacaacccacccacccatttttccagtcttctgagcttgagagacttctttagcactttaaagccccctcctgagcttgagagatttctttagcatgcaagagcttgacccattccagtcaaaaactggtaaggctgcaaagctaagaatcggttgggttggtgatgccattctgcttaactaaggcgcctgttgtccccacataagcaataaaaattaaataaaaacataaaagaaaagtaagtatttctaccattggcccctgggggcttgctgctgctgctgctgcccactgctatttcccccactgctatttggggcggccatattgtaagccccaatcatgtggccgtggtgaccatagaccattccacctggtggttgcccatacgctgcctgctgctgcatatgtggcagagactgagactgtaccctattatagctactagggttcataccactgtaagcattagcattagagttttcaattgaggagccattaatggaagtgttaccttccttggaaggaatctggtctccttgtttggccatggagaccttctcgccctccatttctctgtatttgtggagatagatcttgagcggctcaacatagtcctcaaaccctagggtcgtcatcgcccacagcagatcgtcgccgttgatcgtctttctcttctcccgctggcacttgtcnnnnnnntcgcnggtgatgaaactgatgaactcnnngacgcactcctgtacnntctnctnngcgnncnnnnnnnnnttaccgttggcgggcag

SEQ ID NO: 10283 - DNA, 882 bp, Picea glauca
  misc_feature (2)..(2): n is a, c, g, or t
  misc_feature (4)..(12): n is a, c, g, or t
  misc_feature (22)..(24): n is a, c, g, or t
  misc_feature (32)..(38): n is a, c, g, or t
  misc_feature (40)..(42): n is a, c, g, or t
  misc_feature (68)..(71): n is a, c, g, or t
  misc_feature (845)..(847): n is a, c, g, or t
  Predicted polypeptide sequence is orthologous to G1364, G481, G482, G485
gntnnnnnnnnnaaggaacagnnncgattccnnnnnnntnnnaatgtgagcagaatcatgaaaaaagnnnntccagccaatgccaagatatcgaaagatgccaaggagacggtccaggaatgcgtttcagagttcataagtttcatcactggggaagcttctgacaagtgtcagagggagaagaggaagaccatcaatggggacgacctgctgtgggcaatggggactctagggtttgaaaactatgtggagcccctcaaggtctacctgcagaagtacagagaattggaaggtgaaaagacatcaatggccaaacagagtggtgatcagtcaccttccaaggatgcctctagtggcagtactgttaatgggtctagtgcaggcaatcccagtattagccctggaagctctgctaaatatagcgggggctactatccacaggcctatgggggccaagctgcacagatgtatggacagcatcagatgctaactccttatcagatgcatatcaacactggtaaagctggtggtgcaggagctgctaacagtggagatcatcatcctagagggcagtggtagaagtagaagagtggacactgattttcctgtttactgtatagtgagtggttgttgcagagttctggatgtgtatggggatggaattatgaaaagaaaagttttgctttcgttttctctgcttcttcgcctctgtaaacagagtacatgggcttctcatgggagcttcatgggcatttagcataaattgaggtgaggctgtatatttctgtcaactttaaaatttcaaaatcctgtatagcgcaatttagcttcctgtggttttttannnaagtagttgctctcctatgaaatgggtacaactca

SEQ ID NO: 10284 - DNA, 905 bp, Picea glauca
  misc_feature (763)..(769): n is a, c, g, or t
  misc_feature (862)..(869): n is a, c, g, or t
  misc_feature (874)..(874): n is a, c, g, or t
  misc_feature (876)..(886): n is a, c, g, or t
  misc_feature (897)..(897): n is a, c, g, or t
  Predicted polypeptide sequence is orthologous to G1364, G481, G482, G485
gttttgcaggtttctcacctgcggcgcgcgtttggttcgttggatgacaaaaacacattctaattgtatttattcatctcccctccaagagagcagcggcagccatggcagacttagcgagctccgtcaccagccaagaaagtcctcactcagaagacacgaacaataacagccacaaccagggttccaatgcccgggaacaggatcgattcctccccattgcgaacataagccgaattatgaagaaggcggttcctgcgaacgccaagatcgcaaaggacgccaaggacaccgtccaagaatgcgtctccgaattcatcagtttcattaccagcgaggcgagcgacaagtgccagcgtgagaagcggaagacaattaatggagaggacctgttatgggccatgggtaccttagggtttgaagattacgtggagcctctcaagctttacttgcataaatatagagagatggagggtgacagcaaaggagctgctgctagcaaatctggtatgggggatcccactaagaaagatttgagtaattttggagcagtagcaaatattaggtgaataaattctgttcaacaaaaccagggattgaaccatattcaacaggtcagattttgctgcaagtggtcatttgaaaatgtgtatgcgttacgatgcttggaagggtgaaattgtgggcttggaagctcctagtaataaaagacatgtttaattttttgaaataataaaaaatttgtgattaatcattgacatcnnnnnnntttgctgagtaatctatgtgatccttgtacataagagaaaatcctaagtttgatatgaaagatgtttttttatggcagtatatttatatgacnnnnnnnnggctngnnnnnnnnnnntcttgttatanttatttta

SEQ ID NO: 10285 - DNA, 875 bp, Picea glauca
  misc_feature (765)..(766): n is a, c, g, or t
  misc_feature (806)..(813): n is a, c, g, or t
  misc_feature (822)..(829): n is a, c, g, or t
  misc_feature (844)..(844): n is a, c, g, or t
  misc_feature (849)..(852): n is a, c, g, or t
  misc_feature (866)..(866): n is a, c, g, or t
  misc_feature (868)..(871): n is a, c, g, or t
  misc_feature (874)..(874): n is a, c, g, or t
  Predicted polypeptide sequence is orthologous to G137, G145
atgaacaagaccttggaaagatacgaaaaatgttcatatgcaatgcaagatactacaggcgtctcggaccgagaagcacagaattggcaccaagaagttacaaagctgaagggtaaggttgagctccttcagcgatcacagaggcatttgttgggggaagatcttggtccactaaatgttaaggagctacaacaacttgaacgtcaactcgaagttgctctggcacatcttaggtcaagaaaaacgcaggtgatgctggaccagattgaggagcttcgccaaagggaacggttgctacatgaagtaaacaagtctctgcagaaaaagctttccgaaacatagggaagagatgtaataactggcatagagcagacttctaatactaatactggtactaacgggccttgggattcttctatcacaaacaccgcatatgctctctcacaccctcaacaaaactcaaatgcaagcctccaccatgtggactgtgaacccacactgcagattggatatcagcctgtgcctcctgaaagcatcggccctcctcatcagcctcagcacaaccaaacgcagaatcaatacatgcaagggtggtgggtttgatatttaaggatttatcattatgatttacacttcaatcactacataagccaaaacatggcaaattccgaaactatgattatattatcataaaaggaaacctcttctcagtgtatagcagtacgcttgattttactggtatgatatcttaagaagagttgattnngcaaacaaacccttctggtatattggaccttgttatcgannnnnnnnaattgcatnnnnnnnntatactaatctggcnactannnngagcttcggaaaantnnnngtnc

SEQ ID NO: 10286 - DNA, 730 bp, Picea glauca
  Predicted polypeptide sequence is orthologous to G1382
ttttttttttttttttttgatcgaataaactgatagaaatgaaatccccactaaccaatcgatgcaaaatattggctgccaaaaaatgagtcattgagaatggccatgacgtgataaactgcataacaggtgaagcttgaaccatgaacggcaaagtaacaaagtgaacagcaacattaagaacaagagttgttttacagatgaacataaaaatatatagtatgaagaaagcacaagtgccctttttacaggaaatttgtgtaaacgaatagagcctaaagatcagtttccatattgatcaatatcacgctgtgcataatatttgctaacaatataatggaccattcgactgcaaatctccttatacattagttgtcgctatttatttgtggatctccttatagctttcagggagcaaagataacggagctggcttctagactgaatggcagtatttacaaagcttggtgggctgcatacttgaggacaggttcaggacataagctcgcgttgacaagaactatggcaggcttagagccttgctacagtaatatgatgggttttccaatgtagtagattacagaggggctttcatggttgtgtgtgccctcatatgtagttatcagcagtctctgatcacttggatcacgttcgttttccgagcatctatagtagctccctgggatgagggctacttttaacgacctttctcccatacttgcgccatttc

SEQ ID NO: 10287 - DNA, 832 bp, Picea glauca
  misc_feature (43)..(51): n is a, c, g, or t
  misc_feature (773)..(773): n is a, c, g, or t
  misc_feature (787)..(788): n is a, c, g, or t
  misc_feature (803)..(805): n is a, c, g, or t
  misc_feature (808)..(811): n is a, c, g, or t
  misc_feature (814)..(815): n is a, c, g, or t
  misc_feature (819)..(830): n is a, c, g, or t
  Predicted polypeptide sequence is orthologous to G140, G146
aggatagatcgtcttactccttaattatacaaataataaagtnnnnnnnnnccatgttttgaagttataatgtgccacacacggaacacatttacaatgcaatatatattacatctcaacgttagaactaagtgagtgagtacttagatcaaatccacaaggaacatgttggttaggtaataaagttgtaaatccatgtgttagaagtgaggtaattcccttgccatttgtacattcgtccaactttccttgaagcatcatgttgctcatccttaacgtatgctccttattttgaagggttttaatctcctcaagcatgagttcattcttttttgatcgtacttgatttattcctttttgtagacaacattctaattgatttagctcctcaaatgtcacagaaccaagcccttctcccatcaaatatctgttgctgttgttgttgctggtgccgagctcgtacagctttcctcggctggagaaaacaatgagagctacctctgcatcgcacagcactgaaagctcgtaggctttcttcatcagaccgcctcgccgcttgcagaaggtcacctgcctatgcacgctattctcgattttcttgatctctattttaccgcgccccattttcacaacgacagcaaaatcccaagagtttccgaaatctgagtatatgcaggcgttaaacttaaagatgttttatgaacaggataactgagcttccttccactagtttggactagcttcagggtttactaggttttgcagaatagtcnagctctcattaatnncttcctgctacgatnnnagnnnntgnngcannnnnnnnnnnnag

SEQ ID NO: 10288 - DNA, 882 bp, Picea glauca
  misc_feature (3)..(3): n is a, c, g, or t
  misc_feature (7)..(12): n is a, c, g, or t
  misc_feature (23)..(23): n is a, c, g, or t
  misc_feature (25)..(27): n is a, c, g, or t
  misc_feature (35)..(35): n is a, c, g, or t
  misc_feature (37)..(37): n is a, c, g, or t
  misc_feature (39)..(43): n is a, c, g, or t
  misc_feature (54)..(60): n is a, c, g, or t
  misc_feature (100)..(100): n is a, c, g, or t
  misc_feature (849)..(855): n is a, c, g, or t
  Predicted polypeptide sequence is orthologous to G1451
ganacannnnnnagcgcaaggantnnnggcaatgntncnnnnntagccagttcnnnnnnngttacggacttactgaatgtgcctccttgtgctcctgtcnctgggttctctatgaattcaaatatgggtgtgtctggaggtatagatgaaagtgggttttcacagcctgcaccaaattttgcaaagatgaatacacctacaagaacattcactaaggtttacaagttaggttctgtcgggaggtcagtggatgtaacacgtttcaggggctatcaagagctgcgtgccgagcttgaccgtatgtttggtctagaaggccagctggaggacccaagatcaggctggcagcttgtatttgttgacaaggagaaggatgttcttctccttggggatgatccttgggaggagtttgtcaataatgttcggtttattaagatactctctcctccggaagtgctgcagatgagtcaggacgatatggaattgtggagttccattcccactcagcagcagacaagcagtagttcagaagattgtgtagctagaaatacttctcgcaatatcaattcagttctcacatcgactggatcactggattattgagtgtagttcaattgtactatatcaacagttgtgttttgtctttaaaggggatcctaaaaaatgagatgtacttcaattcagaactcttaggtatgccccataatatgttcttccaggatatctaaatgatgaagtgggatttagcatcattttctctgattgaagttgataacttgctgcattgttctagaaccgtctttggaaaatatttccttgtatctctatttatactctagttttctcttnnnnnnncaaggatgaagaatgctttgttcctga

SEQ ID NO: 10289 - DNA, 896 bp, Picea glauca
  misc_feature (784)..(784): n is a, c, g, or t
  misc_feature (786)..(786): n is a, c, g, or t
  misc_feature (821)..(821): n is a, c, g, or t
  misc_feature (829)..(831): n is a, c, g, or t
  misc_feature (853)..(853): n is a, c, g, or t
  misc_feature (855)..(863): n is a, c, g, or t
  misc_feature (868)..(877): n is a, c, g, or t
  misc_feature (881)..(881): n is a, c, g, or t
  misc_feature (883)..(887): n is a, c, g, or t
  misc_feature (889)..(889): n is a, c, g, or t
  Predicted polypeptide sequence is orthologous to G1451
gttggaggtgccttgtcccaactcccttcatcccaatctcagccagcaataacattgccatcgtccatgtgtccaaagccattgtttgcagattccaatggaaatctttcttcagccatgacgattccaagtatatctactcttcaaaatatattaggctcttcgtctggaggagaaaattccaactatttgaacttgcccagtactagctctgtagtccatcagcctgtgggaatgttaacaggacatggtattccccgtgattgccaaatttcctctagttcatgggttcaaaagctgttagcaaataatgtggtcccctgtcatccaggtggacaagttgaacatcttccttcaggaggtcaatgtgttgtgccccaaacagaatctcttggccagtctaatattccatcgtcatctatgccaatgtcattacctcaattcacatcaagagaatgccctccagagcaggaaattcagtctgattctcagagccaccttctttttggtgtgaacatagattcctcatctttgattgttcctaatacagtatcgaacatgaggaatgttggcagtggtagtgatgcagtcatgcaatttagtgtttctaattatttgagcgcacctccatgtgcttctggttctaatatttcattgaattcagacatcagtgcttctgcatgtttggatgaaagtggacttttaccacccactgaaaatttgggacagatgaatgcacctacaagaaccttcataaaggtttacaagcaagggtcagtcgggngntctctcgatatctcacgcttcagcagttatccagngctgcgtnnngaacttgcccgcatgtttggcntnnnnnnnnnccagnnnnnnnnnnctcnannnnnangctggca

SEQ ID NO: 10290 - DNA, 600 bp, Picea glauca
  Predicted polypeptide sequence is orthologous to G148
ttttttttttttttttttctgaagtggggattgtttgattttgatacataaacttgagcagaatatactcatctgagtacacagttggaatctcttgctatatctccaagagaactgaaccactaacaagaagggtcaaagcatagacagcaaacaagtgttacagcaggctggtctcttggaagaataatttccacaggagtacacactttgtccctgtaacttctcgaaaccatatacaaccgacgcatttctaccatatagttccattgtacctaacatattgtaattaccttatacaaagctgggagattggatgatgcattgaaacctttataaagaacatgatctcgatcttacagcacctacatatgtgttgctagtctttgcgaggatgacagagtaatggtagttgtagaattgtttaggaaatcattgaagaaaggttatgatctcaagatcttactcgatgacaacatttcctgtttgctagaaatgatgggagagattacatatcaattcagttgacaacagtaatagcaagttcttgagatgttcattaataaagccatccattatctatgaaaaatcgaatttctg

SEQ ID NO: 10291 - DNA, 485 bp, Picea glauca
  Predicted polypeptide sequence is orthologous to G1480
ttttttttttttttttttaaattaaaatttcattaaattacagggaaaatagactttaggtaatcacatggtacaaattttacaaaccagaccaggccggtaattagtgcaaaaattacgtggcaataaactggggacaataatctttacaagtgaatcagatacctgccttccgccacatgcaaccctagagtcaacacgtcacagaccactagacaaatccctcgggcggtgttttcacatttaaaacgacgggacgaggccgtagctgagctcggccgacgtgtacatctgagccacgtcagcatcgacccgcttggcaaagcgccctttgatccgcggcctggtctctgcataagccttcctggaagcatacctgatcgtcttctcgaacttccggttctttcttttctccttatatctcaaaaccctagcttcgcggtccagctggacgtactggatgcccacgttcacaacgcctgggc

SEQ ID NO: 10292 - DNA, 826 bp, Picea glauca
  misc_feature (674)..(678): n is a, c, g, or t
  misc_feature (680)..(680): n is a, c, g, or t
  misc_feature (690)..(691): n is a, c, g, or t
  misc_feature (694)..(695): n is a, c, g, or t
  misc_feature (737)..(738): n is a, c, g, or t
  misc_feature (751)..(752): n is a, c, g, or t
  misc_feature (761)..(765): n is a, c, g, or t
  misc_feature (777)..(777): n is a, c, g, or t
  misc_feature (779)..(780): n is a, c, g, or t
  misc_feature (790)..(792): n is a, c, g, or t
  misc_feature (804)..(807): n is a, c, g, or t
  misc_feature (812)..(812): n is a, c, g, or t
  misc_feature (821)..(821): n is a, c, g, or t
  Predicted polypeptide sequence is orthologous to G1510
tccacacacatgccatcctctaatcatttcccttttgttcgcatttacccggatgcaactgatctctgctaatttttttacaaacactgacctatccccaattcacaagctctcattctgcgagcctaaattaacataaccaacttctccaatgaagttggtacagaaacgatctcccaaaatgacataattatatcatctgcacagtgtatgttaaatagtagcacagttcaactatctgggtgcttatacatgttctcattcaaatattactcagtcattctgctttgagctccagctctgcaagctgtatattttatcagaacagtagaaaataagaggggtatccagagcaccagattgtgacagctgctggcttggtcttggcacggttttcatatgttttgcatcggtattctatcagtttggtagccataaatttcctgtttatagaataaggatggcagcacagaatattgcaggagccttcctaagaggtcaggtaggaggtacaccctgttcctcccagccaattatcattcctggtgcttcatctggcccttgttcaacttgcacacttccattcccgttgggttcctctccgtcttttcatcaccacggcatccattctcatttgcattcaccaggggaagttggaaattctctattaagcnnnnngngcaggctatnnagnngtgaaggtggaactgccccttctaggggctacagagatgtanntgttactgctgtnncatcttttnnnnncctccttggtgncnnattcaaaggnnntgacacagctgnnnngactngacagcagnatgct

SEQ ID NO: 10293 - DNA, 843 bp, Picea glauca
  misc_feature (7)..(7): n is a, c, g, or t
  misc_feature (779)..(780): n is a, c, g, or t
  misc_feature (799)..(801): n is a, c, g, or t
  misc_feature (811)..(811): n is a, c, g, or t
  misc_feature (813)..(814): n is a, c, g, or t
  misc_feature (819)..(821): n is a, c, g, or t
  misc_feature (829)..(832): n is a, c, g, or t
  misc_feature (836)..(836): n is a, c, g, or t
  Predicted polypeptide sequence is orthologous to G1510
tatatancttattttctttgtacaatattgggtgctctctaatccaaattctggaaaacggcaccacacagactcagtaaatagataataaatagataaatacagcgattaattaattaagcattaacaagtccacaagataaacccatcaacagcaccgctccctcttcttcgtccttggcaaacgatctgcgcatcttcatcacggaattggtgctcgtttcccctttctcatccccagcaacgcttccattattcaagaaccggcgctcggttgaactggaatcttccaccgaccggcgctcggttgaattggattcttccacgaaccgccgacgatccctgtgacgaccgcccgtagcggcggcgatgttctttttgcgcaccgggtacctcgcggcggcgatggctgcatcttgcggcaacagatcatattcatctctgtcttgttgcttgcgcttccctgtcatctgcctgacggacgacaggggagggagccttgaacccgttttctgctgctcgcgctttccgatcttcttgaaccgaataccgcaggcattacacagagactttggtccgtccgggccatttctccagagcggcgttctgtctgttttgcattccgcgcacgtcctggcaactgctccatctggaaatttagcgtccgttgctccagttttatccgagtgattttctccaatctgtaaaaacctcctcagcgactgtagactttctttggcgctacttttctttctattttcctgcaactttctttcgtnntcgtccccgacttcttgcnnnggatcaatantnncagannnacggagcnnnntccntcgtgcc

SEQ ID NO: 10294 - DNA, 503 bp, Picea glauca
  misc_feature (465)..(465): n is a, c, g, or t
  misc_feature (485)..(493): n is a, c, g, or t
  Predicted polypeptide sequence is orthologous to G154, G1797
gcaagatactcagtatttaaaacaggatattgcaaatatggaagaaaaaattaagattcttgaatcaagacaaagaaagatgttgggcgaggaactggcatcatgcgcattgagggatttaaaccaattggagagccaggttgaacgaggattgagacatatacgagcacgaaagactgaaatattggtggatcaaatagaacaacttaaaagaaaggaacggatattaactgaagagaatgctttcctcagtaaaaggtttgtcgatcctctctatgagaatggttccgttttgacaactgctgcaaatggattaggaagcatccaaaatagtgaagtcgagactcaacttgttataagacagccgagatcattttcttgttaatacttctcattgatattcactgatgataataaatctattatatattattaataaaaggtaaaggcacctcattgttcagnaacttaaaaaaactgtcatnnnnnnnnnatggacgttt

SEQ ID NO: 10295 - DNA, 808 bp, Picea glauca
  misc_feature (767)..(773): n is a, c, g, or t
  misc_feature (782)..(787): n is a, c, g, or t
  misc_feature (789)..(799): n is a, c, g, or t
  misc_feature (801)..(803): n is a, c, g, or t
  misc_feature (806)..(807): n is a, c, g, or t
  Predicted polypeptide sequence is orthologous to G154, G1797
agacgggggggtgtttctgtaatttctatttttttggtttttatgtttttggattctcagcttcagcttatgagtcgaggagccgcttgggttctttttggaagccattacagggtttaaattttttcgccttccattttctggtggtgattgttgtgattccctgattcgagagtctgattcattgcttcgagggcattagggagggcaagagagaggagaggagtctggagaatggggaggggaaagacccagatgaagaagattgagaacgtgaccagcaggcaggttacgttttctaagcgaaggaatggtttgctgaagaaagcttacgagctctcagtgctctgcgatgcggaagtgggacttattgtcttctcaccacgcgggaagatttatgaattttccagtcgctgtatgcaaaagatgttggagagatatcaaacatattcacaagaaagtgacataagtaatgctaccaaagagcaagatactcaggaacggatcttaactgaggagaatgtttttcttagtaaaaagtgtgttgatcaatatgctgatagttcggttctgaaaacacctaaaattcaagttggaagtatccaggacattgatgtggagacccaactgttaataagacctccaattgtacaaggtcacccttatctggatagttttcattgatattttttcattccatttcaataatttatataataaatttgttattattacatatatgttaatttttttatattttcattatnnnnnnnaacattatnnnnnnannnnnnnnnnnannnaanna

SEQ ID NO: 10296 - DNA, 798 bp, Picea glauca
  misc_feature (11)..(16): n is a, c, g, or t
  misc_feature (52)..(59): n is a, c, g, or t
  misc_feature (773)..(781): n is a, c, g, or t
  misc_feature (789)..(790): n is a, c, g, or t
  misc_feature (792)..(792): n is a, c, g, or t
  Predicted polypeptide sequence is orthologous to G154, G1797
attaaaaattnnnnnnatcaaatttcaacctttatccaagttgtgttgatannnnnnnntcaaaaatacttagaaagacactgcagttgtaatgtctgtataatgaaaaaatgagaagcttgcagtcgtactgtctgtataatgaaaatatgagaagcttacatatgcattagtaacaattttattatataagctatcgataggaaggggatcttatacatttggaggtctcataaccagttgagtctccacttcaatgcgctggatgtttccaagctggagtacaggtgatgtcaaaaccggaccatccacgtattcagcacacttccttttaagttgttctatttcatccaccaatactttagtcttttgtgctcgtatgtggttcaaccctcgttcagcttggctttctagatgatttaattctttcactgaacatgatgctagatcttcccccatcatctttctttgtgttgattcgaggatcctaattctctcttccatatttgcaatttctcgttttaaatgctgattatcttgttctttggtagtgttatctatgtcactttcttgtgaatacttttgatacctctccaacattttttgcatactgggattggcgaattcatagagcttccctcggggggcgaaaacaataagtgccacttcagcatcgcagagcaccgacagctcgtaagctttcttcagtagaccgttcctgcgcttagaaaacgtaacctgcctgctggtcgagttctcgatcctcttcatcnnnnnnnnncccctcannantctcgt

SEQ ID NO: 10297 - DNA, 873 bp, Picea glauca
  Predicted polypeptide sequence is orthologous to G154, G1797
cagtagcactcattatcgggtcttaattgtaccccctgtccttcgacactggcgattgttctcattgcctgatctgatcaaactgaggctctgtgattgattgttttgagggcaaaagagaggagaggagaatggtgaggggaaagacccagatgaagaggatcgagaacaccactagtaggcaggttacgttttctaagcgcaggaacgggctgctgaagaaagcttacgagctgtcggtgctgtgcgatgccgaagtgggacttattgttttctccccgagagggaagctctatgaattcggtagtcccagcatgcagaaaatattggaaagatatcaaaaacattcggaagaaaatagtataaataagatattcaaagaagaaaatactcagtctttaaaacgggaaattgcaaatatggaagaaaccattaggattcttgaatcatcacaaagaaagatgttgggggagggtctggcatcttgttcattgaaggaattaagtaatttggaaagccaagctgaacgaggattgagccatattcggtcacgaaagactgaaatattaaggaatcaaatcgaacaacttaaaaaaaaaggagcgtattttaagtgaggagaatgcttttctccataaaaagtgtgttgattcccgatatatggatggttcggtttcgggaagccctacaattggatttggaggcgtagaacaggtgacgaatcggtgactttaacatcatggagtgccttaacaacacattatgtcaccgactgtcctacacctcggagacgcatgcaaggctatagatattttctgctggttgcatacatttttatcttattgtttacatctctaattaaaatgagtatca

SEQ ID NO: 10298 - DNA, 883 bp, Picea glauca
  misc_feature (792)..(797): n is a, c, g, or t
  misc_feature (827)..(827): n is a, c, g, or t
  misc_feature (829)..(835): n is a, c, g, or t
  misc_feature (860)..(864): n is a, c, g, or t
  misc_feature (869)..(881): n is a, c, g, or t
  Predicted polypeptide sequence is orthologous to G154, G1797
gacccagatgaagagaatcgagaacgctaccagcaggcaggttacgctttctaagcgccggaatggactgctgaagagaccttacgagctctcggtgctctgtgatgccgaagtgggacttattgttttctcccccagtgggaagctctatgagttcgccagttccagcatgcaaaaaatgatggaaaagtatgaaacctgttcacaagaaagtgatataagtgaatcaaacaaaaagcaagatcctcagtctttaaaactagaaattgaaaatatggaagaaagaattaggattcttcaatcaacacaaagaaagatgttgggagagtgtttggcatcatgttcaatgagggaattaaacgacttggagagacaagttgaacgaggattgagccgtattcgagcaacaaagactaaaattttattggatcaaatagagcaacttaaaaggaagttagatgacattcaagtcaaaaatggttatagttcaacaccttcagttggattgggaaggatacaacacatggaagtccagactcagctagttatcagacctcctgatgtacaaggtcatctgtaaatgtgaattcgaaattgcattggatttgatgagtagttagaggatatttgaaatattttggtttcattttagtttcctagtttagttgatcttgggaatatctttccaggttatgtaaacagtttgataactgccacagggaggttttaccctgtggagaaacttataaatacttattatttttgtaataatatcatcctcattcgtgggcnnnnnnggatatggaattttaatacagactgagacnannnnnnntattctgctacagctttagcttttnnnnntatcnnnnnnnnnnnnntg

SEQ ID NO: 10299 - DNA, 636 bp, Picea glauca
  Predicted polypeptide sequence is orthologous to G156
ttttttttttttttttttctcaaaaaatttaaatattttataaaaaacattaggcaaagatccaatcaattgcgaatattctggggggaatgaaaacattgcagaaaatgggaaatttttcttttccagaggatctcgcttctttccacacaataaacagtctaacccattttcgaccctttatgatctccattactgttctggctttcaaaaaaatagacaaacagacagttcctgcccaacagtacaggaggaactgtaaggaatacatacttggaactggaatattcagagagctttcccgagccagaaaatacaacaagcccaacgctggcatcgcacagtattgccaactcccgggctttcttgaacaggccgcgtttcctcttggtcaatgtcacctgcctcctcgtcgtgttctctattttcttcatctctcgcttccctcgccccatgattatactcaaaaatcgctaccccgtctgtaaaatgggaatcagttcacatatacggaaaaactaggtttcaggaaccttaagacagttcacgggatcgaccccgggcagacaatcctcgacaaaatttcacactccggcaaattcagctcgctatcccggcgagttgctggaatgaaac

SEQ ID NO: 10300 - DNA, 893 bp, Picea glauca
  misc_feature (845)..(849): n is a, c, g, or t
  misc_feature (869)..(883): n is a, c, g, or t
  misc_feature (892)..(892): n is a, c, g, or t
  Predicted polypeptide sequence is orthologous to G1646, G715
cacaaccaccaccaacatcatccatcttcttcttccggcggagcagcgccgcaaggcatgtctcagggctatcctggcggagcagctgctccccctacgcctgtgggcatgcagggacaggcggggcagcagccacagcctggtctccaccagagcggcgcgcagcaggccttccaccaccaccacatgcagcagcagcagcaacagctccaaatgttctgggctttccaaatgcaagagatcgagcaggtgagcgacttcaagaatcaccagcttcccctcgcccgaatcaagaaaatcatgaaggccgacgaggatgtccgcatgatatcggcggaggcccccgttctgttcgcgaaggcctgcgagatgttcattctggagctcaccatgcgttcatggattcacgccgaggaaaacaaacggagaacgttgcagaagaacgacattgccgctgccattaccagaactgacatattcgatttcctggtggacattgtgcccagggacgacctcaaggaagagggtttgggtttagggtttgccagaggtggcgtgacccccgagggttcattctattaccctcctccttccatgccccaatcgccacatcaacagggaatgatgggcccctcttccataatgatgggcaggcctgctccacttcagatggacccatccgccatgtatatgcagcagcagcagccaccccgtccctatggtatgcctcctcatcctcaccagcccatgtggcagcaccctcatcatcctcacccacaccaacaacaaatgcccgacggacaaagttatggacatccacatcagcagcagcagcacttgccggnnnnncagtcttatgggcaacatcnnnnnnnnnnnnnnnattcttatng

SEQ ID NO: 10301 - DNA, 835 bp, Picea glauca
  misc_feature (790)..(792): n is a, c, g, or t
  misc_feature (799)..(808): n is a, c, g, or t
  misc_feature (819)..(825): n is a, c, g, or t
  misc_feature (828)..(834): n is a, c, g, or t
  Predicted polypeptide sequence is orthologous to G1646, G715
cttccgtttctcatggaccatcgagcttgatgcataattcgatcttccaacagcagcagccacagatgcctatgcaacatcatcagcagcagctacaggggtcaatgcagcctcatctccattacatgcagatccagaaacagcagctgcagatgttttggcaacagcagatgcaagagatggaacaaattgcagagtttaagcagcatcaacttcctcttgccagaattaagaaaataatgaaatctgatgaagatgttaagatgataagtgctgaagcccctgtcctattctcaaaggcatgcgagcttttcattttggagcttacattacgttcatggttacatactgaagagaacaaaagacgtactttgcagagaaatgacattgcaggagctataagcaggggtgatgttcttgattttcttcttgatattgttcctagagatgaagtcaaggatgaggaatatgggggacactggcctgggattcctcatgcagaatctatgtcttatggagggatacactttccactcatgcatgctcagccttaccaccacaatcttaatcctgatgtgatgactgctcaacaaacaatgtctcagcaattaatgtctcagcagcctttaatgccagaccagcagttgatgtaccaacctccacagcaatgatcataaggttggatggaagccagagtatcaatcaagaatgatcaggctgattgctctcgagcctagatagcatcctcagaacagccatattttctcaaaaacagcatttgattatgagnnncagcttnnnnnnnnnnctttattggtnnnnnnnttnnnnnnna

SEQ ID NO: 10302 - DNA, 663 bp, Picea glauca
  Predicted polypeptide sequence is orthologous to G1765
ttttgtttttttttttttatataaattaaatttgatatttattgattataatttaactcttatgattcaaatgacccagtacaacacatacaaacatggccagtcaattaaatgaactgtaatatatatgtagggcggataaacagattccgcagcaaaccagcaatatcatcctcccaaaaagagtaatgatctctgtaattacttatctatatctgtgcaataagaacatctccgtgtttttgaaaggaaaaaaaaaattgcacagacaaaattgaagtgattaatggaggaactctggaccatttcatacaaatgcaaaacctcctccttacttcgtcctcatcgtatatcgaaactgcttttctccaacatctactatttcatcgctttcaccctggattgccactgataatattgttactgctggaagtggcggaggtggcggtggttcggttgcaaccagaagttctgctaacttttttctcttttccatgcaggagattgccccaccttctccagttatctgctccgctgccataatagccaagctgatctaatttaacttcgaatctagactgatccaatctcttcgttggatctgatttataagattaaacagtacaagatctaaagattttctcaagtcaaaatcccaaactg

SEQ ID NO: 10303 - DNA, 829 bp, Picea glauca
  misc_feature (41)..(49): n is a, c, g, or t
  misc_feature (763)..(768): n is a, c, g, or t
  misc_feature (770)..(775): n is a, c, g, or t
  misc_feature (800)..(801): n is a, c, g, or t
  misc_feature (803)..(803): n is a, c, g, or t
  misc_feature (822)..(823): n is a, c, g, or t
  misc_feature (827)..(828): n is a, c, g, or t
  Predicted polypeptide sequence is orthologous to G1767
atagtcgatcgcagcttacatgatttttttttggtttacannnnnnnnntccaggcagaagcccaaatggcgcactgctccttccatgttaagaaaagcccgtcggaattgctacagtgaccccatccctccttgtatctcttgagaagagccctaacatcatcaacaacatcatcgctgaatgcagcatgtatgaatcctgcctccttcagcctccaagcccactgtgcgcccttctcccttcgctcataaacttcagaatcatcgcaggccaatatgttcaccatgctccttgcactggttctttcaagcatcaatctctcgttgctcgttctagagaagctctcctctagtgaatcgaaaaacaaggaaaaaaaacgaaggcattcgctaaaacaggaaccaaaatcctcatgagttaggtcgacctcgtcctctactacagtaacaatcttggggttcatgctgtagaacgtggacaatatggaatcccttccattcttagagacgcgttgcaggctgtggatacagttgatggcgagggcctcgtctggtctgattttgagggcactgacgttgagcttgtggagatggtgctgatggatgacactgaattcgaagggaacccccatgagcctcgcgaatttctccattcgttgccctatttctttcatgaccttgatggccgtggcttccttgctagtgaccacggtagtcaggcggagatgaggggtgtcgtcgcttctggtggccaaggcttctnnnnnngnnnnnnactgtgtacagaaagtgttgctcanntntactatgtggagcttcatnnctcnnt

SEQ ID NO: 10304 - DNA, 556 bp, Picea glauca
  Predicted polypeptide sequence is orthologous to G1772
ttttttttttttttttttctacatgatcttacagcggaacgattaattttgtgattgtacggacagatcacttggctgttagagattgtacaggaagcagtactggtacagctgatatgtgtacgaaatttttttttttttaattctcttcagaatttgcaacaaaataatttcagagaaactctgaaattatctttcctcaattggccttggcagcggaatagctattccttcaacagatagttgaatttttaatggtcaaagaccatgagatcagagaaactctgatcatttttcagttggctagaagcctgtggtgaagcagattaatttcttccttcaatttctttgacagcagaatgattattttttaaacagtgatttctgatttttttatttattttgcagctgattagtttcttccttcaattttctttggcagtggaatgtcttcttcaaatggccaaaggccaggttttggtcaaagaccgaagtttcaagaactttgaaaatttgaatggtcaaaggcctggttggtggtcaaagaccaaatttc

SEQ ID NO: 10305 - DNA, 822 bp, Picea glauca
  misc_feature (8)..(10): n is a, c, g, or t
  misc_feature (12)..(12): n is a, c, g, or t
  misc_feature (19)..(24): n is a, c, g, or t
  misc_feature (48)..(50): n is a, c, g, or t
  misc_feature (191)..(193): n is a, c, g, or t
  misc_feature (235)..(235): n is a, c, g, or t
  misc_feature (260)..(260): n is a, c, g, or t
  misc_feature (285)..(287): n is a, c, g, or t
  misc_feature (345)..(347): n is a, c, g, or t
  misc_feature (438)..(438): n is a, c, g, or t
  misc_feature (818)..(820): n is a, c, g, or t
  Predicted polypeptide sequence is orthologous to G1809
tcccgagnnnanttcaaannnnnnctgtttagttcaaagtgatgcggnnnatggcagaaggtaaaacaggagcccgggactgcagcaggaggatgtaaaatatgcgtcatgccgaaacatccataatgaacattgcattgccttgtatgttcaggctttttttctcactgttggaagcgatcttgaataannncttgaacattcggtggacatgtttggttccttctagtgctanctgcattttctaccagtgattttanctgccagcaattttacatggggtannncagacaagccagagttcttcattggcagctctgttctctcaagactggacaacaatcnnngcagtctgttgcgcacactataaataacggaattctatactacaccataaagaacacacgcgtctaaaaagattgctgaggaacagagtanctgctcagcaactgagggtgaggaagaaggcttattcgaacaagttggaaatgaagtccaaggagcttgaacagaagaagagagggtgtcaactttccagagtgaatatctcatgcttaaacaggttctgaagaacatgacagagaggagcagaggaggtggatttcgtgaagtagaagggcagttatatgatttgcaacatttgaaagatgttgcagtggctcaaattcttttgtattgggctgtgttttcattttgtcaatcaccataaatcagttttcaaccttttcttaggacgtgggctatgttaacgtctaacatgttgacttttgttggaagccatttaaataaaaatagaaaaggaaattcctgcctttttnnnca

SEQ ID NO: 10306 - DNA, 836 bp, Picea glauca
  misc_feature (755)..(755): n is a, c, g, or t
  misc_feature (757)..(757): n is a, c, g, or t
  misc_feature (759)..(759): n is a, c, g, or t
  misc_feature (768)..(774): n is a, c, g, or t
  misc_feature (809)..(812): n is a, c, g, or t
  misc_feature (819)..(820): n is a, c, g, or t
  misc_feature (823)..(835): n is a, c, g, or t
  Predicted polypeptide sequence is orthologous to G1855
gtcctataagtctcttgtagtttgcgaccctgtcagtccatagtttagaatcttcattgaaattttcagctgtaattcccggaatactgccactccttattcggggaggaacagctgttacacgcttcggccacttttctaaggctcctcctgcaactgcattgatatcattgacctctggaagtggtgttatgcaggtttccatctttctataccaagcagcatcagggttatcatttttacaaatatgaggaaccttgtaaatatttctgctcttcacacaatcaatgtgattcatgggcttttgccatatagcaagatcacccttttcaacaaccttcttccaacataaacgtttggcaacatcctcaatagcatcttgctcttgtttcagatcttcgggagttctttcccatcctctatgatattttttccaatttactggggggccagataaaatccagtaaccaccaggcctcaataccctgtccacttcaatcaagtagacaccatcataatctttccatggaatcagacatcgagaacaatgagccatgtcaaaagctcttgctggatatggaatcctttgagacgccatgatccctatcattgctggaacgccccgttccagagcaaactgcacctgtgcttcatgtgtgtcccttggtgcaaaggacatggttaagatattcctctttagcagatatgctccccaactagcaaccccacaccctgtatcaatggcagtcctgatngntncatctgtcnnnnnnntcaacttatcgatatcatcaatataagcatctgcnnnncgagtgnncannnnnnnnnnnnnt

SEQ ID NO: 10307 - DNA, 825 bp, Picea glauca
  misc_feature (711)..(714): n is a, c, g, or t
  misc_feature (754)..(754): n is a, c, g, or t
  misc_feature (758)..(759): n is a, c, g, or t
  misc_feature (769)..(769): n is a, c, g, or t
  misc_feature (805)..(820): n is a, c, g, or t
  Predicted polypeptide sequence is orthologous to G1855
cacatgaggcacaggtgcagtttgctttagagcgtggtgttccagctatgattgggatcatggcatctcgccggcttccatacccagcaagagcttttgatatggctcattgttcaaggtgtctgattccatggaataagtacgatggtatcttcttgatggaagttgaccggatcttgaggcctggtggttactggattttatctggacctcctataaattggaaaacacattttaagggctggcagagaacaattgaggacttgaagcaagaacaagatgaaattgaggatattgccaagcgtctgtgttggaaaaaaattgttgaaaaggatgaccttgcaatatggaaaaagcccacaaatcatcttcactgtattaaaacccgcagagtcttcaaggttcctccaatgtgtgaagatggtaaccctgattctgcttggtacaagaattcgaagacttgcataacccctcttccacaggtcaaggttattccagatattgcaggaggggctgtggaaaagtggccacaaaggctaacatctgttcctcccagaataaggagtggaagtattccggggattacagctgaaacttttactcaagacacccaactttggaaagctagtgtgtcatactatggaagtatgataagtgaacttaataaaggaagataccgcaacatcatggacatgaatgcttttctgggtnnnntcgctgctgcctttgtgaatgaccctgtttgggttatgantgtnntgccatcagntgctaaacgcaacacactcggtgtcatatatgagcnnnnnnnnnnnnnnnnatatc

SEQ ID NO: 10308 - DNA, 887 bp, Picea glauca
  misc_feature (776)..(779): n is a, c, g, or t
  misc_feature (789)..(794): n is a, c, g, or t
  misc_feature (848)..(860): n is a, c, g, or t
  misc_feature (865)..(865): n is a, c, g, or t
  misc_feature (867)..(869): n is a, c, g, or t
  misc_feature (876)..(881): n is a, c, g, or t
  misc_feature (883)..(883): n is a, c, g, or t
  misc_feature (886)..(886): n is a, c, g, or t
  Predicted polypeptide sequence is orthologous to G1888
tttgcaggagatacatattgttgtggggaaactggatcggtaatcttgaatttgttgcagattcggagaaagatgaaggttcaatgcgacgcgtgccagagcgcggatgcatctgtgttttgctgcgcggacgaagctgccctctgtatgaaatgcgattccaaagtccatgacgccaacaagctcgccagcaagcaccgcagactgtctctcctcgagcccagctcatcatcctcaacggattctctgagatgcgatatatgccaggaacgaagggcgttcttcttctgtcaagcggatcgggctgtcctgtgcagagattgcgatttatccatccattctgcgaacgaattgactgcaaaacataacagatttttggttcctggcaccagagtttctctgaaaccaatggagactttgtcctgccctgagaaagcggtggccactgtcaccaaggcattaatgccacctgcccaaaggatgccgaatcatgcccagccatcaatggatctgcctgtagaaaccgtaacaagtaccagtaacagcgacttctcacagtatttgaacgaggttgagcaattcctaacttcggcttcccctgagcgtctcgactggggtggttcatctgagggtgacgctattggaaagtacatggactcggactgggcacccaatctgggcctcctgcctgaaggtttctatggagactcgctggcagaagtccctcacatgccatcgcccataacagattctggattctgtatatatagccgatnnnncatcaccatnnnnnnaaaggcaaagcagcagcagctgcagcaggtgccatattttcttcctggtttcgnnnnnnnnnnnnntaacntnnntgttccnnnnnntntant

SEQ ID NO: 10309 - DNA, 526 bp, Picea glauca
  Predicted polypeptide sequence is orthologous to G189
gttgatgcttttattgctctcccagagggtactacaagtgcaacagcataaggggttgcccagcaagaaagcatgtggaacgttctttggatgatccatccatgctgattgtgacatatgaaggagaacacaaccattctcagtccatgtctgaaagcacaggattggtggtggatccatgaggctttttgcagattgattcatgtgaaggcacaaaagattttaatccatggccattgtttgtgtgcaatgggccactttctatggaatgccttgaagaacctttatagggaagcagccagctgatatcgatgctaaactttttttcatggcctctaatgaggttgttttggcaaagctgatctcgtttgcataatgtgataaaaagagatctttgtggagtactgtggaggactatttcactgcccaagatatttaaattttggtttacatgatgtacagactatgagactcttaatcgaatagaagacatgaaagagttctctaatggggaaaatttatattg

SEQ ID NO: 10310 - DNA, 706 bp, Picea glauca
  Predicted polypeptide sequence is orthologous to G1936
ttttttttttttttttttctttgggttcaacctaaaagcctttgatttcattggttgtttttttggttgagttgtccctacccttggatctttgacaagtgttgaagatccaagaggggtctccttggtttctttgcctatttaagaaacctctccctcactcttttctcaccaatctcttgctaactctattatgctgaaatttttcactccactctcttgctcttgccacattgccatccacttcacttgctctattatttgataataagaagaaagctttggaggactacatggtgcatttttagttatcttctatgctccaccacatgaggtgatattgctctactttttgcagatttgtttatggtattgatcttaggtttttacttaggtaagctagtcgaatgttatccatcactagtttatgattcataaagaatgacctaggtttgtagtgatctcttcttagtgttgttctagtaatctatctatgccatatacttgtatgtactaagcttttgcaggtaattttctaaagcttcacttgggacaaggttcgagaaagagtcctcccttgaggctttcacaaactccaatcttctttctttctatcataacctttttctgcagtcattccatataccttttcagcctttgttttagctttagataggtcatatatatcatttctatactctatttg

SEQ ID NO: 10311 - DNA, 711 bp, Picea glauca
  Predicted polypeptide sequence is orthologous to G1950
ttttttttttttttttttaagaatcaaaagacagatcttaagaattccagcgaggccttttaaataatgccgaatttctatgcatggaaaaagtaattcactcggaaattatgccgaaactagaggaatatataatcgattgtgtacaaaagaatttacctgagcaagattacatagggtcttaaatgtattgaaagacgtaacaaagtattataacatcaaagtctttagctgctctctataagcacctcttctcaactgttagctcaaaatgccacattattgttgtaacatcccatctttgaggcctgatggcatgttttagctaaaaagcataaatactatcagtcatcaagcatgactttggcagcatcaattagtgttctcctaaaatcccctgaagctcgaccaaggactgtataaccttcattgtcttcacaatcgacatctgcaccatgccttactagaagtaaagcaatctgcttgtcattgctgattactgcattcataagaggtgtttgacctgttttgtcagtggcatcaacatctgcaccttcctctatcaacagttcacatatttctgggtgccctgcacttgctgcgcgatgcaatggagtgcaaccaaacttgtcctttttcctgacgttggcaccattggagattaaatcttgggcaatcttaacccgccctttactggcagcataatgcaag

SEQ ID NO: 10312 - DNA, 638 bp, Picea glauca
  Predicted polypeptide sequence is orthologous to G1957
ttttttttttttttttttgtttagaaaataaagatttttaatctccaaatgagaggcgttttagttacaactaaaagggtagagcaacaccctaccacgaaaacaatcgccttttactgagccaaatttttggctgtatttactcctgaactccctatcaaggatacatcgggaaagatcatcttcttccatgaaggtcttcaactacctgaacctatgtaaatactgtacatatggtagcatgaaggtcttcaactatctgaacctatgtaaatgctgtacatagggcagcccttaatggctagacaattcagcaccacaaaactctaatggaggtgaggaaagttaatgggatcatgcgattcctttgaggatcgaaatttttatgtttttcaatggaagtacagttatatttcatcttcttataaatatgtacactgtatcagaataataatattacataagttgatatataatatatatttcaacatatataacattaattatttcaatgcagaatacataatctttacacagataaattgaaccttttataaatatcggtttaatttacaacagcttagaatgacagaatgacgtcatgatgaatatccacagccattaaaccttaataacct

SEQ ID NO: 10313 - DNA, 467 bp, Picea glauca
  Predicted polypeptide sequence is orthologous to G2011
ttttttttttttttttttagtcctccaaagcttttcttctattactgaaaaatgagagattagtggatgagtggcttgtggcatgagcaagagaggtggggtgaaatttcagcagcataacagtagccaaaagatagatgatccaaatgaggaggggtggggtctttcttatacccaaagaggcaaagtgaggggcccttgatggctgccatgtgttggcaatccaagggagaggaggcttctagagagagggcgccctaattagggttagggttttggataggtgaggtggcaagggcgtggggacacaagagagaagagagaatggccaagggggcgcaccttctagagagaggagggcccacgtccaagtggaagcccattgattggctaagggaagagagagggcgcaccttctagagagagggcgccacttgggtgagagaagaagggcgtggggaccacta

SEQ ID NO: 10314 - DNA, 835 bp, Picea glauca
  misc_feature (45)..(53): n is a, c, g, or t
  misc_feature (761)..(762): n is a, c, g, or t
  misc_feature (772)..(773): n is a, c, g, or t
  misc_feature (812)..(828): n is a, c, g, or t
  misc_feature (832)..(834): n is a, c, g, or t
  Predicted polypeptide sequence is orthologous to G2226
gatcatctccagaccttctcaggccaccttagaaaacctaaagtnnnnnnnnngaacaacttctaagttctaagtcttctctacatataggctttcctgctatatacagaagaagtattcactacataaccttcagaaaacaggattgctttcaataggagaagcaacaaagcatcctgtagaaataagcacttttcctaaagatgatttacaataaaagattacagaatctccaattatagacccagataactggatgaagtgttgaaggatccttcaaagcaggatccaagcaactctaactttcaatccatgtatgatgataagcagcttcttggaaggatgaacaccaaaataccgattcatctgtaagctcctgttccctgagcctgatattcttggctgcttcttcggatatcagacatgatctacacaagggacaggtgatctgctgatggtccagccatttatcaaggcaaggtctgtgaaaaaggtggcagcaagtcagctgtctgatctcaaccccttcctcaaatttggataaacagactgcacactcaacatggctattgtcactaccaacaaacccatcagtaaaagattggaaccttttgatgggtaggctctgcctgatttcctctgcaatgaactgcgcttcggaatggccagtactgactgcaggggtattttcaggtgggtaaggccatgatgggtcgataaaatcaggttcagtgcctgtggtaaggcctacaatctgaagnnaagacctcannatgtccttgataatggcaaaagacagagcagtattcacnnnnnnnnnnnnnnnnnctcnnnc

SEQ ID NO: 10315 - DNA, 668 bp, Picea glauca
  Predicted polypeptide sequence is orthologous to G2251
cagagaacaaaatgcacgggttccctattggttactgggataatgtagaagtcccccagctagtgctcaaccttgtgtttgtcttggaattgagcaggcttttggccaattggcttctctcccctttcggtataccagaccatcaatatggcgctccccgggatcagcccctcaccacttggcccatcactcctttaactaatactatcagtgttcgttattccggccttatcttctccgcttctatttcgccttcttcccctgtccctccataccgtgaccagcagagcgttcgtgagaatttgcccaccgtcttcgactacgggagtctcagagctgatcgccatgaggttgttgtctgtactgtttgtttcagtgactttgtgtcgcgggatcgagtgcgccggcttgctaaatgtggccatgttttccatatggagtgtttggataagtgggtcgaatatgagaactacatttgccctctctgtagatctcccatcttttagacacaggttgaaatcatcatcatcaactattataagtctgattgattgctgtgaattgttaatgtaagtctagtaggatagattttatggacattttgctggccacatgaaaaggcttctgtaataaaaatgtattgtggatttattgaccttttaatcttt

SEQ ID NO: 10316 - DNA, 875 bp, Picea glauca
  misc_feature (12)..(15): n is a, c, g, or t
  misc_feature (768)..(768): n is a, c, g, or t
  misc_feature (781)..(782): n is a, c, g, or t
  misc_feature (805)..(806): n is a, c, g, or t
  misc_feature (841)..(850): n is a, c, g, or t
  misc_feature (857)..(864): n is a, c, g, or t
  misc_feature (869)..(869): n is a, c, g, or t
  misc_feature (874)..(874): n is a, c, g, or t
  Predicted polypeptide sequence is orthologous to G227, G242
gcacgaggagcnnnngcagagcttgtaatactcaccgacataacgcaacagaagaaaaacgttttcaaataagagagagcgagaccgaccgacagagagctctacagatcgatttcgatcctgttgtgagctgaaacaatgggagttcccaaggacgaagcggcggtgacaatggcggtggcggagcggatcaaggggccttggagccccgaggaggacgcaacgctccacaggctggtggagaaatacggaccgcggaactggtctcagataagcagaggaatcccggggcgttcggggaaatcatgcaggctacggtggtgcaaccagctgagcccccaggtagagcaccgccctttcagcccacacgaagacgctaccatcatacaagcccatgctcgacatgggaacaaatgggctacgattgctcgtctcctccccggccgcaccgacaacgcgatcaagaaccactggaactccacactccgacgccgctaccatggtgagaaggaccacagcaacgggctagtagtgaacttggaatcggcggctgaggacaaggaagcgatgatttctctcacggcaccggcaatggtaccggctttagttttcgcagcggctgcggacagcagcagaaaacggagcaatagtagctgcagcgcgaatgacaatccgggagatgccgaggtcgagtctcgtcggcttaagaggcttaatttttctgaatccccgactagttctgataataataataataataatgaagangacactattagtnntcattgcaattcggtcgccccannatcgagtcctgtacagcagctgcatcgtcctgttnnnnnnnnnnctgcttnnnnnnnntatgnagctnt

SEQ ID NO: 10317 - DNA, 852 bp, Picea glauca
  misc_feature (2)..(3): n is a, c, g, or t
  misc_feature (15)..(20): n is a, c, g, or t
  misc_feature (44)..(49): n is a, c, g, or t
  misc_feature (740)..(745): n is a, c, g, or t
  misc_feature (769)..(770): n is a, c, g, or t
  misc_feature (780)..(781): n is a, c, g, or t
  misc_feature (783)..(783): n is a, c, g, or t
  misc_feature (806)..(810): n is a, c, g, or t
  misc_feature (823)..(823): n is a, c, g, or t
  misc_feature (825)..(827): n is a, c, g, or t
  Predicted polypeptide sequence is orthologous to G2394
tnnaagaacatcaannnnnnattttatttagcagcaagacagannnnnnaaatgcaacttagcactcatcacataaaaaaccttggacaacgctaaaagaccactgccaacctatgtgaccaaacttgacaactgacaactacactgcaaacaagcatgttgcatagccaagaagattcatggaaccggcattgcttttgccgaacatgtctaatttgttaaggggggcttcgaagtatatgcattgcccatactctagattattattgagcaagccgaaatgctttggcaatatactcaaacatttatagtataacagccttgctccatttcttcaactgtgcattttcaagcaaaccctatggcttgcccagtatttttgagagatcttctctgtttataatgttagtcagcgactcagcacaactcatgtacagtatgcaacagacaaagttcctctgctttagctaaggtcacaaagattccaacggtagaatttcctaattcacactccctcattacgagaacctctatctctctgttcttctgtttcatgaaaagattcagcttctacttcactagaatcaccaatctcatgcttgcagagaggacaagaagcattaattttcagccatttgtcaacacattctacatggaaatggtgcgtgcaaggaagctccctcagctctacatcatctttgtatttgccaaggcaaatgcaacaaaccgcatcttcagcnnnnnnagatctttcattgtctgtaccagnngctacaaagnnancctcatataaactgtccgagtcnnnnncattgtcatcttnannntcagtgctttcatgttcaacttttc

SEQ ID NO: 10318 - DNA, 903 bp, Picea glauca
  misc_feature (765)..(765): n is a, c, g, or t
  misc_feature (848)..(851): n is a, c, g, or t
  misc_feature (870)..(870): n is a, c, g, or t
  misc_feature (872)..(874): n is a, c, g, or t
  misc_feature (878)..(883): n is a, c, g, or t
  misc_feature (886)..(891): n is a, c, g, or t
  misc_feature (898)..(902): n is a, c, g, or t
  Predicted polypeptide sequence is orthologous to G255, G664
cttgcagctaagttgcttcattctcctgtgttgaagatggggagatctccctgctgtgaaaaagctcatacaaacaaaggggcctggaccaaagaagaggacgaccgcctcatcgcccacattcgagcccacggcgaaggttgctggcgctcgcttcccaaggccgcagggctgatgcgatgcgggaagagctgcaggctccgatggataaactacctgcgtcccgatctgaagcggggaaacttctcagaagaagaagacgagctcatcatcaaactccactccctcctcggcaacaagtggtctcttattgcaggcagattgccggggcggacggacaacgagataaagaactactggaatactcacatcaagagaaaattgctaaacaagggactcgacccccagtcccatcgcccccttggccaggtccacagcagcaacactacctgttcctctctgcccgcccctgagcacgaaattctggcgttccagagcccgagaacgccggagatagcagatttctttcaatacgaacgctctgaaagctcgccgatagagccggccgcttctaaagacgaagagtatcccgacttaaatcttgagttgtgtatcagcttgccggttcattcggcccccgccgcaagcagggcttcgagcgtcgatagaaccgtggattcaaaacctaattctggcagcgaactgtgctgtcccatggggctgcaagtaaattatggcgcgcaatgcgagaacagatatagtgangagaatgcttcaggtttctcgagtcattacaggcttgtcttatagaagctttatggtttgcttattaactggtctccgattcnnnnacgaagcattcatatgatnannngccnnnnnnaannnnnntgtttannnnnt

SEQ ID NO: 10319 - DNA, 638 bp, Picea glauca
  misc_feature (612)..(614): n is a, c, g, or t
  Predicted polypeptide sequence is orthologous to G264
gcggatcaatgatgtgttttgggaacagtttcttactgagagcccacagccaatagacacagaggggactgattcagagagtcaggagagtagtaaggatcaagacgatgttgtgcctgaatatagcaatttctgtaatagaagggagaatcttgatcaacttacactacagatggggcaactggcatcatcagtaaacctttgacatcagactaagcatgagtatttaagtcactgcagcattaacaacaggcgaatataggagggccagtaaagttaattgtttctcaagaacacaagcaggttctaggtgtatcttatgttgctctttttgatgcttctttcaagattctgctagttatatcggttaaatgcttgcgagagatatgataaacagagttctatcaattttttatgcatcactctgtccaaaatgcattgctgcttatttcagcgggtgggttggaatgtaagtaggacttcaggtttgttgatgcgattggccttttcttaaaaccatccactagggatgtgtcttatattgttccactttgaaaaggggcaatcctatctatattagaactttctttacttgttatgcatagtgattannngaaaaaaaaaaaaaaaaaaaaaaa

SEQ ID NO: 10320 - DNA, 412 bp, Picea glauca
  Predicted polypeptide sequence is orthologous to G268
ttttttttttttttttttttggtaaaggtcatgctggaaactcatcaccttgaataaatgggtcacaccttttgcagaaaattacactgatcatatcaaaaatggcacattgggaaataatattacattgaatgacaatcatgaccagtaattcaggaacgcaattgctgcttttgaccaaatagcaccttcctactaacataggctccctcttctgtatcaaacaaaagtactctccatcccattgcctttgcaattggctctatttcaaaaaaaactactctgttatctccaatataagcatatccaccaggacgcaaaattcggtccatctctaacaaaatggctggtatggtacatcttttccgctcagtggaaaataaacccgaagcatgaagaagatcatagcctc

SEQ ID NO: 10321 - DNA, 845 bp, Picea glauca
  misc_feature (754)..(758): n is a, c, g, or t
  misc_feature (780)..(786): n is a, c, g, or t
  misc_feature (793)..(798): n is a, c, g, or t
  misc_feature (802)..(808): n is a, c, g, or t
  misc_feature (817)..(819): n is a, c, g, or t
  Predicted polypeptide sequence is orthologous to G274
atgagataaaataattttattaatgtccaaaaaaagaccaaagtaggtcaaagggctaaaagagtacatctagtgtcgatccaaagtaggagtgccaaggcatctcctaaaacaatgttaaaagaagaaagacaaataaatgaaatgtaatctttttatgatatccatcacattaatgattctagaaccccaaaaatatcactgttctattccaacagcataaaataatgaatctgttagccacatggtgtattcactggtgtacccagacctctcacaagtacaatgggtgtctgctcatctgcatttccagcaggattgtctataaggaccatttccagatactttactcaatcaaatcaactttttcttacttttctattgttttatttttcttgttgctttcgagtttgatcctggtttgtagctgcatctttcctttcatctggtcttttgccctcgaggacagggtcaggttacgacattacgtatatgtttgaacctgtccacgcccattcacattaatttcttcaatggactgcattccacccatgatttccatgtcctatttataagttgttatcgttcagtggctttccgttattgtaagggtccatggcacgctgcatcggctcataagttaggaaggttttctgaacagctatccggcttcaaatttgagatacaagatgaggtcaaaaacaaattcagcagacagcaggaccaggagttctgtttctatctttattgtttnnnnnttatgctgttttttctacgtannnnnnncttggcnnnnnngtgnnnnnnnaaagggtgnnngcattgcattggaaatcaccaagcta

SEQ ID NO: 10322 - DNA, 633 bp, Picea glauca
  misc_feature (619)..(627): n is a, c, g, or t
  Predicted polypeptide sequence is orthologous to G2754
gaatgagacaggcaatgaagaaactgaagataaaaaaaaagttcaagtaatatcaaagttgcatgcaatccttagaccttttcttctcagaaggttgaaagaagatgttgaaaagaaccttccttcaaagaaggaaataatattatatgctcgtatgactgaagatcagagaaaaatccaagagcatctactaaacaaaagtcttattacatatctacatgcgaggtcgggaaaatctagttgatgaatttgggaatttgtattactggtacatcttccgaggcaatgtatttgaagattcttctgtctacctggtaataattttagtcaattgctttgttagttctgctcctctcgccctttttatatcctatttgcgattcttcgtgtaatattattttaccagtttcatctggaatctagagcattaaatgtaataaccatgtagttgtactattacacgttggaaagaagaaggcatgctactttgtctgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnnnnnnngggggg

SEQ ID NO: 10323 - DNA, 877 bp, Picea glauca
  misc_feature (13)..(14): n is a, c, g, or t
  misc_feature (49)..(56): n is a, c, g, or t
  misc_feature (756)..(756): n is a, c, g, or t
  misc_feature (843)..(845): n is a, c, g, or t
  misc_feature (850)..(865): n is a, c, g, or t
  misc_feature (872)..(874): n is a, c, g, or t
  Predicted polypeptide sequence is orthologous to G2789
ttggttgaactgnntgccaaattcagacgggtcaaccgttacaaacaannnnnnnncagaatcatacaacttattctggtgagaaattatacaaggcaaacaagcttggaaagcaaatctttttcgttagagctgagatgctctattttctccttcctgttcgagcggaacgatgatgacgaggaacgaatttattgcccaacccaaagtctaacttgccctgaaaagggtaaagcacagcacaactctgaatattgtttgtacacctaattatgaatgagctgacctcttcgtgtgggagaagccaagtgaccgcggggcaaaggcgaacaagaatacttgtgctaatagggagtatgggcatgctgtgcccaggcgtaggcgtcatgagccagttggccgttggtgagcagactggggggaacattgaaggtgggcatggtggacggatcgggcatctgctgctgctgctgttgctgctgcgccgccgccgtcatagcggatgattgagagagtcctccagggcgctggagctgcatcggcatcggcatcggcatcggtccctcgtcctcatcgaggggcagacgttcgtagggggagttacggaatgtggcagccgttacgacgactggaccggaggccaccagggcgcccacaacgctccctcccactacttgtccttgtccgccggcgagatagattgtgaggcctgtagccccgggcggcacaggcggtggcaggaacgaaccggacagngataggatctcgaaccgtccgtgcaaggtcacaatcgcgctaggtgcggcagcctgcctcaggttaacattcatcaccatgccgctnnngctgnnnnnnnnnnnnnnnngctgccnnntgc

SEQ ID NO: 10324 - DNA, 879 bp, Picea glauca
  misc_feature (13)..(19): n is a, c, g, or t
  misc_feature (22)..(22): n is a, c, g, or t
  misc_feature (24)..(24): n is a, c, g, or t
  misc_feature (46)..(54): n is a, c, g, or t
  misc_feature (56)..(56): n is a, c, g, or t
  misc_feature (58)..(60): n is a, c, g, or t
  Predicted polypeptide sequence is orthologous to G2790
cgggctgcaggannnnnnnacnangccggagggagcccctccagtnnnnnnnnnanannntcaagcaataataatttgccaaaaaatactgttgatgaaggtggagagtgcactactgaacaaaagagaaacagcgatcaagcggggctttccaacacagctttcaagaaacctagaacagaagcttctgcgggcgctccgatgaaggtgcgcaaagagaagctaggcgaacgcattacagcgttacagcagctcgtttcgccgtttggaaagaccgatacggcatccgttcttcttgaagccatgggatacattaaattcctacaagatcaggttcaggtattgagctcaccttatctcaaaggcattccctccaatcaaaaggatgggcgaggagatcaggcgaaatacgacctccggagcagaggattatgcctggttcctgtatcatgtactctccatgtagccaacaacaacggggcagatttctggacatctggaatcggaagcggttccaagttttgacatcctgcaaccccttttttttggtttttcttttcagtctgttcctgcgtttttcaacggaacagttgtcacctttaccacataaattcaaagctaatagtagaaaagcagaaagatgaggacgggacgaaaagcagtcccgtcctcgatgtcccatttagattatgattctctgtgatatatataaaatatgtatatgtctgtctgagaaaagcagatgcaacctgcaaagatgctatactgcttttccccctttatctattgacgccattttgcactttctgtgtatggctgtgtattgacaatgatgtgacgaggccaaaaacactaaagaaaaagcaaatgcgtttgtta

SEQ ID NO: 10325 - DNA, 913 bp, Picea glauca
  misc_feature (804)..(809): n is a, c, g, or t
  misc_feature (858)..(862): n is a, c, g, or t
  misc_feature (875)..(882): n is a, c, g, or t
  misc_feature (886)..(893): n is a, c, g, or t
  Predicted polypeptide sequence is orthologous to G2791
cacaggaggcagctgtaacggcagcgacggaggaatgcttcctcttcctctcagtcttggtcaggctggaaagtccggcgacatgaacgagcccggatcgcgggaagaaattgaagcttctttcaagtcggtaaataatgcccgagattcgaacctcggagggctattccagccgttcgccgtatcaccgcggggcgttcgaccgaccggtcaaaacttccatgcgcagcccggacaagtgccattgcaagggtatggtggaatgccccaacctcagcatcagaatccacctccgaccggagttggtgctgcaccacctgttcgacctagagtaagggcacgccgtggacaggctacagatccccacagtattgcagaacgattgcgtagggagaggattgcagagagaatgaaggctctgcaagaactggttcctaattccaataagacggataaggcttctatgctggatgaaataattgattacgtcaagtttcttcagctgcaagtgaaggttctaagcatgagtcgactgggaggtgcaggagcagttgctccccttgtggctgatatacctgctgagggtgccaacgccccacaaggcacaagaaccaacggtagccagaactcttctccggacggtctagcattaacagaacgccaagtagcaaagctaatggaagaagacatgggaacggccatgcagtatcttcagggaaaaggtctctgtctgatgcctatatctctggcctctgccattaataactccggttcgagaccccaggctccttccaccccttctcnnnnnngactattggcatctaatgttaacgacaggcaggtactcgaaccctcctnnnnntcggcactatctnnnnnnnnctcnnnnnnnnatgacatacagccatccatc

SEQ ID NO: 10326 - DNA, 715 bp, Picea glauca
  misc_feature (705)..(705): n is a, c, g, or t
  Predicted polypeptide sequence is orthologous to G2802
gaaagttctgagtgcagtcctctttggcatcctggcaatctagaggtgggtttgcgtttgagtaaggagaaccagctagttcaagcttctgatcatgctggaatgcaccctaatattattgaggactgggcctgtaagcttgaagagtccaagaatggttacgttggtttggacgagcatcatataacgaggctactccagtgccatgaaacacaaatggacggcatttcaaacgcaaatccactctcatatagcacccaggaattgaatgatatagcagaagctttaggtttaagccttaacgatcaggaagggtctgctcagaaaattgatagacaattggaggacatttttatgtatccgcctcctgagctgcagaaaactttgtcaaacagtcaagaagctgattggctcgagtactccttttgtccagattcttataatggctgttcccactatggaggaccgatttgatttagaaggcacactgtgttgtactgtaaacagtagtccaatgacgttgtccattgtttggcatttaagaaagcggtatttggcgcaccagcaccgagagcctcagcataattttccagagaagcgttacacatttatttttgttcactgtaaaaagctgcattatcctcgctccctgcgagattgttgtatacttctgactatctattgaattgaaaaacacaaaaaagntttccgacgt

SEQ ID NO: 10327 - DNA, 786 bp, Picea glauca
  misc_feature (734)..(740): n is a, c, g, or t
  misc_feature (775)..(781): n is a, c, g, or t
  Predicted polypeptide sequence is orthologous to G2802
cctttttcttgtatgcatatatatttacgatctcgttgataaaacgtagctcccagtctatcagatcagaaattcgttgttatcttcaatattgttcttgacatccttctgaggttattgggatgaaacagatatgatcactgaattccccaaaacatatgatacccaataaaagtatcaatggctgacccaatggcaaatttttctgggaaggagaggagtaatgcaaccaacagctgcagtttgattgatgccaaacttgaagagcaacaaatcagtggatcaaaagtatgtcctagctgcggtcacaagtttgaattcaaggagggtattcaggattggccagggcttcctgcaggagtgaaatttgatccaactgatcaagagcttctggagcaccttgaagctaaggttgagattaatggccacaaacctcatcctttaatagacgagtttattcctacgctggaaggagaagatgggatttgttatacccaccctgaaaaacttccaggtgtgacacgagatggtcttaatagacatttctttcatcgcccttcgaaagcatacacaacaggtactcgaaagagaaggaagatacaatcagaatgtgatttacagggaggagaaacactttggcacaagactggcaaaaccaggccagtgtcagtcaatggaaaacaaaaaggatgcaagaagatcttggttctgtataccaactttgggaagcacannnnnnntgagaaaacaaattgggtgatgcatcagtaccacnnnnnnntgcaa

SEQ ID NO: 10328 - DNA, 305 bp, Picea glauca
  Predicted polypeptide sequence is orthologous to G2838
ttttttttttttttttttttgggctggaaacagaacccttttaatattgcccgaaatccgggagcgagggataaacatttcttggatttgcgacaaacatcaatgaacccaaattccccccccgattaacggttctggattgcaaaaaaccctttaaaggttgccgaaaaacttataaaaatttcccccgaaggcaaagcattggggggcaccccggggctttccctccggaaagcttggggcggccccggggttattttaccggaaaaacccctaagcataagccctataaaaggggtccccct

SEQ ID NO: 10329 - DNA, 880 bp, Picea glauca
  misc_feature (2)..(10): n is a, c, g, or t
  misc_feature (57)..(60): n is a, c, g, or t
  misc_feature (776)..(776): n is a, c, g, or t
  misc_feature (799)..(799): n is a, c, g, or t
  misc_feature (853)..(853): n is a, c, g, or t
  misc_feature (858)..(859): n is a, c, g, or t
  misc_feature (864)..(868): n is a, c, g, or t
  misc_feature (870)..(877): n is a, c, g, or t
  Predicted polypeptide sequence is orthologous to G2989, G2990
gnnnnnnnnnttactcaaggccaaatggcagaaccaaagaccatacaggcacagccnnnngaaccctaattgaatataaaagctgcctagaagagggaataaattactttacacttatgctgacttcgatctctgcagtgaaagatctcaacagaagatacccttctcgtgatgaaggattcaggagtgagatccaaaggaaagagatatttttcaattcataaattcaggaaataaaaaggattaagcagaaaacagctgtcccccaaaaccccgaaagaatgcctgaaatccatagaaattcaataaaactcccatgtcggtaacataattttcaagatttcttaccgagagtatgcttgttgttatgcatccagaccttcaaaacacccttcccgacaccaatttcattacaaaactgctgaacaatagcctcatcctgcttctgcatcctccaccccatcttatctgcgaacatatacatcttctccttctgatcctgcgagaacttggtcctgaacctcttcttcatgcctctatgatgatggtggctgaggttattattactgttgttgttggtattgccatctgggtcatcagactcggtgagaccagagcttagcgccatgagcatatggggagccgaggaaccgtggggcaaggggagggggtaataggggacaacgggggaacccggccctgacgaggatgcgccgccacgcttcttgcggaggcagcactcgcaggtggggggcggttgctcgtcgccctcgacntcacggcggtggaagttgcggtngcatccgcaggcggcgcacttcaatgcgtcgtcttcagcgggcatgaactcccngcagnngtcgnnnnngnnnnnnnngat

SEQ ID NO: 10330 - DNA, 648 bp, Picea glauca
  Predicted polypeptide sequence is orthologous to G2990
ttttttttttttttttttggttatttgtgtttttttgcttgtggagaaggaaggagaagggtttgtggtcttcctcaatcactctgaaggcaacttaacaaccaccatcatcaccatcaaggatttgtaagtggagcaagggttcaatttcatttgccaaccggtgttgaatcttccattcataggtatgtatctagattctaaatccctccattcataggaggaggaggagtggcctgaagacatcatggagggtgatgtgaaaacatcatcacaaccttctacacttattgatacacctactcctgcacacaccaatggtcatccactatcagatacagggtcttctattgtcaggggcaagcctgacaaagaaccccttatcttttctcgtaaaagggggagaggcagaggtcgacattgatattagatagctagttgttgttttgtttcatttgtcattgtatatcatagatctacagactccatcatgagatacattttataattatatatgtgttgtcattttgtattggagaggcccttcaacattcaatatcgactttgatgtataattttttatttggcatccactagtgacagggcttgttgagaggcccttcaacattcaatatcgactttgtcagc

SEQ ID NO: 10331 - DNA, 802 bp, Picea glauca
  misc_feature (2)..(8): n is a, c, g, or t
  misc_feature (21)..(28): n is a, c, g, or t
  misc_feature (82)..(90): n is a, c, g, or t
  Predicted polypeptide sequence is orthologous to G2990
annnnnnncccgcgccatcgnnnnnnnnaaaagaaagtcggggctgccgaaaagacagagttttaccgggcgggggttttannnnnnnnncttttggattattccctcgagtaaaagacggctacttgatcggcgaattcaatggccgaacttcaccgagtttatgcggcctctcttcatatgcgccaaattccgaattttatggataaaattcggcgaatgcggtgacgctcccatcccccttgaatttcctgaaaaattgtggtgtctctcatgtgcgtttccctgctcccgcgtacggaaacttggtggaacattggaaattttctaggttgaaagatttcaacacagggaatgatggcagttgtacagggtaggtgattcttacaaattggggcaaggctttttatttcttacaccatttagtttgtagttgtgggaagttgcgcgtttgtttttcagcattttttttctgaatagaagtttttgcaagtgataggggcgtttcgctatgctagtcttgccacagagaaaattagtccttaacatgttgtcgatttattttcttgactacatacatactgagaatggaagtgccctcttgagctaaagggaatgctgcaagctttggtaaatttaataaaggaatcgggtgtttttgctcaatcatagcaaacatccgagtctgctgtgcattgatacgttattaatggcaactgccaatgcatgtatagactccgtaagaaactgataagtgaatcttttgattaaataaatatttaattaatgtcaaaagtttaca

SEQ ID NO: 10332 - DNA, 894 bp, Picea glauca
  misc_feature (830)..(836): n is a, c, g, or t
  misc_feature (850)..(851): n is a, c, g, or t
  misc_feature (857)..(861): n is a, c, g, or t
  misc_feature (870)..(877): n is a, c, g, or t
  misc_feature (881)..(887): n is a, c, g, or t
  misc_feature (889)..(891): n is a, c, g, or t
  Predicted polypeptide sequence is orthologous to G3075
ggcagctaacaccccaaaatccgacaccccaaaatccgattcttctgcacagtcttcttcagatttcagcgaagagcaggaaaacgcagatgagaaaacgacacccacgacacccacgaaaagacccaccgataatggcgcttattcttctctaaatatagaggaggctgaaaccccaagccgtcctataagaatttcacaccacaagtctccaaggccggaaacgccgacaactgtggcgttccccacggccagagtgaggcgtgtaatcaggagcgagggcgatattcggacaagtgtggaagcgacctttctcattaacaaagccgcggagaggtttttggaacagtttgttgtggactcattcgaacatgttttggaggagaccaaaaatattttaagctacaagcctttttcttcaactgtggctaaccagaaaaggtacgagtttcttgcagactttgtgccggagaaagttaaagcagcagatgctctagctcaaagggcttcagcggaaatttgagcaatgtttgcgagatttcataatttttttgaagcatctatcacttattttgataatgcatttctttgaggatggagaagaacactgtatttcaaaggtaatttttaaattattgcaaatgcagcacaagaaattagcctagcaaggccaaggtcagtttcttttgattatatgtagtatcgggaaactaagtatactgtctaattattgtggagacaaacttgtattacacttatctgcttcaaagcatatggtagctacatgttctagtacttgtacagatactgatacttttttgtcaaatctnnnnnnngcttttcaagaagnngttttnnnnnacttgaccnnnnnnnntgannnnnnntnnnata

SEQ ID NO: 10333 - DNA, 886 bp, Picea glauca
  misc_feature (14)..(17): n is a, c, g, or t
  misc_feature (801)..(801): n is a, c, g, or t
  misc_feature (803)..(803): n is a, c, g, or t
  misc_feature (808)..(810): n is a, c, g, or t
  misc_feature (815)..(815): n is a, c, g, or t
  misc_feature (853)..(853): n is a, c, g, or t
  misc_feature (878)..(880): n is a, c, g, or t
  Predicted polypeptide sequence is orthologous to G309
cttcaatctcaagnnnngaatccaatggccggccttgatacaggccctggcgcttcgtcccggcgggccaccgtctttcaggctaactggaatcggcccgccacagcccgacggaaccgatgccttacaggaggtcggcatgaagctcgcccaactggcagagtccatcaatgttaaattttccttccgtggttgcgttgccaaaagcctctccgacatcaagccatggatgcttaacgcccggcccgatgtcgaggccgttgcagtcaattcgatccttgagctccatcgtcttctcgacgacacgatactcggacaacccagcgccatcgaccgagtcctcgcgtcaatccgggccctaaatcccaagatcgtgaccgtggttgagcaagaggccgaccacaaccgccccgttttcttggaacgattcacagaggcactgcactactattccacggtttttgactccttggaggcgcgcggcctgcaggccacgagcgaagagcaggtgatgtctgaagtctatctgggtcgagagatttgcaacattgtagcctgcgagggatcggaacgagtcgaaaggcacgagcctctcttgaattggagcgttcgcttgcggaacgctggcttctggcctatgcatttgggatccaatgctttcaagcaggccagcatgctgctaagtctattctcgggtggggaaggatatagggtcgaggagaataatgggtgcctaacacttggttggcacagcaggcctctaattgcagcttcggcctggcaatgctatctcacaccgtnangaagnnnatagntgtcactgaaacgatcaaatatactagcaattattgtngcagcatcatcgtttcatcgaaccnnnaacagc

SEQ ID NO: 10334 - DNA, 809 bp, Picea glauca
  Predicted polypeptide sequence is orthologous to G328
ttttttttttttttttttagactggcattagatttattcattaacagagaagattgcaggaagctgaataagtaaacttccatcgacttgaaatcttaaactctggaaaagactaatagtatgtatggctgttcttataagtgtgagtcacacccacttcatctgactgcagtctgacccacatcaatgagcaaggcagaatcagtaagaaagaggcattgaatttgagatcaacccaaatgtgaatagacgtgcctcatactaaccccatctcacaggcatcgataaattgaagatacaaggcattatgattataatggcagttacaattagaataacaaggatacttactaagaagaattatttctattgactggatcaataagatggaacaactccgtatccctgatcaggcagtaaagaagatgagtatatctgctccacttctacctctgttctcttggcaaatcggccttttatacggggccgagtctctgcataggcttttctagacgcatatcgtattgtcttctcaaaccttctgttctttcttttttccctatatctgagaacccttgcttctcttcccatgacctcaacatggcctccaggatgaacaacccgaggcggaatctcgaatactcctctggggtcatggtaaggagttgaaatgtcagttgtagtgttgctgtcaggtacaatcccaacatctatggaagaggaagagacacagtggttgagagatgtagttctgtaaacataattgcacttggatgctgcatccacatccaatgacctagctgtttcaa

SEQ ID NO: 10335 - DNA, 715 bp, Picea glauca
  misc_feature (97)..(98): n is a, c, g, or t
  misc_feature (163)..(165): n is a, c, g, or t
  misc_feature (682)..(687): n is a, c, g, or t
  Predicted polypeptide sequence is orthologous to G328
ggcacgagggaaacagctaggtcattggatgtggatgcagcatccaagtgcaattatgtttacagaactacatctctcaaccactgtaggagtattnnagattccgcctcgggttgttcatcctggaggccatgttgaggtcatgggaagagaagcaagggtnnncagatatagggaaaaaagaaagaacagaaggtttgagaagacaatacgatatgcgtctagaaaagcctatgcagagactcggccccgtataaaaggccgatttgccaagagaacagaggtagaagtggagcagatatactcatcttctttactgcctgatcagggatacggagttgttccatcttattgatccagtcaatagaaataattcttcttagtaagtatccttgttattctaattgtaactgccattataatcataatgccttgtatcttcaatttatcgatgcctgtgagatagggttagtatgaggcacgcctattcacatttgggttgatctcaaattcaatgcctctttcttactgattctgccttgctcattgatgtgggtcagactgcagtcagatgaagtgggtgtgactcacacttataagaacagccatacatactattagtcttttccagagtttaagatttcaagtcgatggaagtttacttattcagcttcctgcaatnnnnnntgttaatgaataaatcttttcccagtca

SEQ ID NO: 10336 - DNA, 462 bp, Picea glauca
  Predicted polypeptide sequence is orthologous to G363
ttttttttttttttttttttaaacattttaacctcttatctgctttatgtatttcaacaaaagcttgcatacccatatctgctgcatgccgtcgtttgctaggattaaagataaaccccaacattgttaaattcacagatatatcgctaatccaaaatgacccggagttttaacccttttatatcaatcaacccccatgaagggaagccttattccacaaccaaaacccagcgattcaaacgacgatttgtaatgcaaaaaattaataatgtttctgtaaggctagcacaagatcacaccaatgtggtatgcatgcgtgcaaatccacttatttcttacatggctaaacaatcccacaaggaatatgaggtcatctctggagtcacccactgtacccgttcccaataccaaacagaaaacaaaccctaaccctataaaccaatcccatctgcaggaaaatgt

SEQ ID NO: 10337 - DNA, 932 bp, Picea glauca
  misc_feature (855)..(855): n is a, c, g, or t
  misc_feature (858)..(867): n is a, c, g, or t
  misc_feature (869)..(874): n is a, c, g, or t
  misc_feature (877)..(879): n is a, c, g, or t
  misc_feature (893)..(893): n is a, c, g, or t
  misc_feature (895)..(895): n is a, c, g, or t
  misc_feature (906)..(913): n is a, c, g, or t
  misc_feature (915)..(915): n is a, c, g, or t
  misc_feature (925)..(929): n is a, c, g, or t
  Predicted polypeptide sequence is orthologous to G4
agaaagtaaaatcctcttcgaaggatgtctgcagatcagatgtgccaatctacggctacgatgatatggaatatggggacttggagttctcaaaacccggtgccccatttcaaagcaattcaaatgcatccacagttcaatcttctgagcatagcaatttaagtcaaactttgcagaaatcgtgctcttgtgagatctgtagttacaactattcagaggtcagcaatttaatgcccactgcttatggcgatgccgtaaattttgaacaagtgaaatcttcccaaccagcaggttattttgattctgatcatagcagcatgtcatttgaaggggcgcatttcccatgggcttatgatacgaaaaccccagaaatttcgtctgtatgtgaggatgcaaatgagtctacctttgtggacattaaaccccaggtagatgatgttgttaaagacggaactgtggatacccctattgaggtcgatggtgggacaggtggattctacaaaacagaggataacaacgttgaacttgagttttctgatttggagtcatatcttggtttgacagaggatccgaatcttaatgcaactgtgaatcaatcaatagaagatgcgggtcatgctgtgggctcttttccagatgtgcagggttccatggaatcatggctctatgacgatctgcccatttcaggtttagtttttcaaaacagtcttagttcttgcttcttataaatacataacaagcaagcagactcgtgatttgaattttgatgttgcaggcctatgtataggtcttttggactcatattttgcactttctgtttatgttttataatttgtttttctattaattaagccnctnnnnnnnnnngnnnnnnggnnngtaggattcgtatntngtaaaattgtnnnnnnnncntttgggtacnnnnnccc

SEQ ID NO: 10338 - DNA, 846 bp, Picea glauca
  misc_feature (770)..(773): n is a, c, g, or t
  misc_feature (785)..(786): n is a, c, g, or t
  misc_feature (796)..(797): n is a, c, g, or t
  misc_feature (800)..(802): n is a, c, g, or t
  misc_feature (816)..(817): n is a, c, g, or t
  misc_feature (830)..(831): n is a, c, g, or t
  misc_feature (836)..(842): n is a, c, g, or t
  Predicted polypeptide sequence is orthologous to G4
ggagcccataatttcatattgagtaatcagtattttctttagcaggtcgttgtttcgtgtcctgcgtagtcagcagcagcttttttgaaagcaaaacgatgtgtggaggtgccattatttcggatttcattcccgccaaccgatctcggcgaataactgccagggatttatggccggatttcgatacgttcgctgagttgttcatcaatggcggagccgtgtcggaatctttcaataaatcaggcagctttgatgagggtttcgtcgacttcgacgagggatacaagcagaagattaagcccagcaagaatattttcaactccaagcagaaattttcttcaggtgatgaaaacgaggcgattcctcctttgaaggatttcgaaaagtccgcagccaagagcgcggggaggaagaggacgaatttgtatagaggtatcagacagcgtccatggggaaaatgggctgcggagattcgagatcccagaaagggcgttagggtttggcttggaacgtttaacacggcggaagaggccgccaaggcgtatgatgcagaggctaaaaagatcagaggcaaaaaagccaagcttaactttgctgatgactcgtgttctgtaaaaatagaccgtagcaaaagaatgtcaaagaagaaagtaaagttatgtacaaaaaacccagatttattattgagttttaatataaacagcaaggtaaaatcttcaaattcaccaaagcctgatttattagagggttattatataaacactcaaatnnnnccttctttgaannatgtctgcanntcnnntcttccaatctatnnctacaatgatatnnagtannnnnnntctc

SEQ ID NO: 10339 - DNA, 930 bp, Picea glauca
  Predicted polypeptide sequence is orthologous to G409
atggcttgtgataggagcgcattgtatacctccagtgtcatcatgaacaccgaggacaacagttctgctcatgccatagctgccatgattgcaagttcttgtactccacctgcaacgtttcaaggtactcgatctataagtgtttttgaaactggaaatgagcgcaaacgaccagctggaaactcctactcggccttggaattgtctgatgacattggggatgaagatggttcggatgattgcatccatttgggagagaaaaaaagaaggctgaccttagagcaagtgagggctctagagaaaaatttcgaaatggcaaacaaacttgaaccagagaagaaaatgcagttggccaaggctctaggtctgcagccaagacaaattgcggtttggtttcagaataggagagcaagatggaaaactaagcaactagagaaagacttcaatgttctcaagcaggactatgatgctctgaagcaagattatgataaccttatggaagagaataacaatctccaggccatgatcgaacgtatgagcagtaaatcacagagctgcaatgaccagaaatttcaggcgaattcttccaaattacagaaagacgatcaggacttgcagcttctcatgatgtctgcaaccaaagttgattgtgcagacaaggaaaataataatgaagggccttctagcattggaagtgaaggcagttctgttttggacatggacagcccgggtaccattgacagccaacaaaatattgattctataggattctcgaacgtgaaagctcgtgaccttcggcttgaatgcaatttcaggcctaaagtagaggaaaatgtgagtcaagcagatgaaccttgcaattacctgttttacaataatttggagactggtccgctcttgtgggattataattggtcttcaggcctctag

SEQ ID NO: 10340 - DNA, 887 bp, Picea glauca
  misc_feature (5)..(6): n is a, c, g, or t
  misc_feature (8)..(8): n is a, c, g, or t
  misc_feature (793)..(793): n is a, c, g, or t
  misc_feature (814)..(814): n is a, c, g, or t
  misc_feature (838)..(844): n is a, c, g, or t
  misc_feature (850)..(850): n is a, c, g, or t
  misc_feature (857)..(859): n is a, c, g, or t
  misc_feature (861)..(865): n is a, c, g, or t
  misc_feature (879)..(880): n is a, c, g, or t
  Predicted polypeptide sequence is orthologous to G409
actcnngnataagagaaatatttaataaacaaagtaggcttgcattcactctttcacctctactttgggcaacttacataagagaaacctggaaaccattagaaattgctatacatcacgatgaagagactttttatgcagccacccttcaaaatcttctaaacacttacaattgcaaggaaaactaaaccttgccaacagtacttctctattttctttcagagtcaattcttatatgctgttacatcattctgctcttattctgggcgagggagatggacagatgaacataacagcagcacgattctggctagtcccaccagggaccaagcggtacttgatcctccatagcaaacatttcattgtaggatgcaattgaagcatctgggtaagggccgtcttccaccttgaggagatgatatgtatatgtctgaggaagcagtttttcactcatgccttcttcttcttcttcttcatcagcatgtgagaggtctgattgatccgcttcaaaaagatgggagttcacatggtccaaggatgaatgcccacagtcaacgtggtgaggactgtcttcatccaggaccccactgctgtctgttccagagctcaaaagatcttcatgtttgcaacttggtggtgtatccttgatagaagtacctctttcaaacttctcaacacactgggaggcgggctggggaaagactttcttatcaacatactcggaatcctttgtttgggcttcaaggtcacagtctttagagtgtaacttgcctgttaggaaggtaacctcagnccttaatttatccttttcttngagcaggctatcgtaatcgactcnnnnnnnctcatngcgtgannncnnnnnatcataatccctcnncaattgc

SEQ ID NO: 10341 - DNA, 838 bp, Picea glauca
  misc_feature (2)..(2): n is a, c, g, or t
  misc_feature (13)..(17): n is a, c, g, or t
  misc_feature (19)..(19): n is a, c, g, or t
  misc_feature (24)..(30): n is a, c, g, or t
  misc_feature (41)..(45): n is a, c, g, or t
  misc_feature (113)..(114): n is a, c, g, or t
  misc_feature (803)..(808): n is a, c, g, or t
  misc_feature (828)..(833): n is a, c, g, or t
  Predicted polypeptide sequence is orthologous to G409
angagaaattgannnnngnggtcnnnnnnntgacagacaannnnnatgccaaagagaaaggtttggaaatccaaacaaatgatttggagacaacatgtaaaaaagcattcatnnaatccaattcccagtttgagagcttggagaaatctgggattgtttccaaaggcatgactgccccttttgatcagcaactggtgagctatagcattgaagaccctcttagttccggaacagacggaagtgctgtcgtagatgaggaaagccctcatcacattgatagtggacattcttcggttgtaggctatgtcacctcaacccatatttcaccctttgaagcagatctgtctgacttttctcatgttgatgaagaagaagaagaagaaggcataagtgaaaagcttctacttcctcaggactgtcatatgaaaatggagtgtatactcttcccagaggcaccaacaacatcttgtacttatgtatttgccatggacgatcaagaaaatctttcgtggtgggactggccataagtggctaatttgctatttagttcattttgtacaaatctatctcactagagcaaaatggtctaatatcaagtagagatccactctccattacttgagaaagtagacttgacatggtaacgtttgtcctccaggttgtaagtgttctggagagtgggctctttgaagcttcctgtatctattaatggatttgccacgttgaactggtttttggtttacatgttttaggaatagatatggcaaactattgtaggtgggacagcaactgaaggcctgctnnnnnngatgaattttttaagcagannnnnnatctt

SEQ ID NO: 10342 - DNA, 831 bp, Picea glauca
  misc_feature (734)..(738): n is a, c, g, or t
  misc_feature (740)..(740): n is a, c, g, or t
  misc_feature (749)..(749): n is a, c, g, or t
  misc_feature (767)..(773): n is a, c, g, or t
  misc_feature (797)..(797): n is a, c, g, or t
  misc_feature (803)..(803): n is a, c, g, or t
  misc_feature (805)..(807): n is a, c, g, or t
  misc_feature (813)..(818): n is a, c, g, or t
  misc_feature (822)..(828): n is a, c, g, or t
  misc_feature (830)..(830): n is a, c, g, or t
  Predicted polypeptide sequence is orthologous to G409
tttcttcttatttctcaattcctccgcctctgcctatgtaaattctcacaataatatatatatatatatatatatatatagccattctcaatccatttttctataatctgtgttgtttctggtttttctgttgtagtgagaaagatttgagtctctgtgtttgctaaggaaatttagtgttggtagactctcgaagcgtatagcagagagtctgtaaacatggatattatggcttgctcactgggatcccgtatgcgtacgttgtggagcacaagcttctttcgtcacaagcactttctctagtagagccattatcagaagaactttaggaagcgagggttagctgtctgtattaaataaaaaatggcgtccaatggggttaggttcaatgcctccaatcgaaatttgatcgtcatggtgaatgaaactccgtctttcgaagctgattcaacgcctctaaccagtttggatggagtgatgaagagtgtgtcaaagaggccattctacaatacacttgatgcagaagaagcaggggatgaggatttgctggacgagtgcgttcatcagccaggaaagaaaagaagactttcggcagatcaagttcactttctggagaagagttttgaggtggacaacaagcttgagccggagcgcaaaactcagttagctagagatttgggattgcagcctaggcaggttgcagtctggttccagaatcggcgtgccaggtggannnnnangcaattagngagggaatatgacattcnnnnnnnaagctatgacactctcagggtggnttatgntnnnttactnnnnnnaaannnnnnntng

SEQ ID NO: 10343 - DNA, 924 bp, Picea glauca
  misc_feature (2)..(10): n is a, c, g, or t
  misc_feature (13)..(15): n is a, c, g, or t
  misc_feature (19)..(25): n is a, c, g, or t
  misc_feature (43)..(43): n is a, c, g, or t
  misc_feature (57)..(57): n is a, c, g, or t
  misc_feature (59)..(59): n is a, c, g, or t
  misc_feature (61)..(61): n is a, c, g, or t
  misc_feature (74)..(75): n is a, c, g, or t
  misc_feature (87)..(89): n is a, c, g, or t
  misc_feature (94)..(98): n is a, c, g, or t
  misc_feature (921)..(923): n is a, c, g, or t
  Predicted polypeptide sequence is orthologous to G450
cnnnnnnnnngannngaannnnnnnctcccaggagcagctgcngatgagtcacgagnangncagaggagctgtnngaaaagaagctnnncggannnnntggagtctggaaactataccattccagatgaggacattacaaggaccggcacacatgaggacgctgataaattcaatggaccaatagtcaaagaaaaacaaatggcccttgctgccaatgaccctgcaagattggaacctcgacctcctcccaaggcacagattgtaggttggccacctgtcaaagatttcaggaaagtgagaacgattcctgcatgcgactctctgtatgtgaaagtgagcatggatggagctccctatctccgaaaagtgaacctcaaaatgtacaatacctaccacgacctctcctctgcactcgagaagatgttcagctgcttaattaccatgggcaagagtcgatcccatgggttgaacgagagcaatttgatggatgtgctgaatgggtcacaatatgtgccgacctatgaagacaaggatggagactggacgaggggggaatctcgcctcagtctcctgactaatctaatctcgacataactgggtaaaaagtgactgttatttgcaaaatatataccgaatattcatggatgtaaggacctgggtttcccattaagttctgtgcagtatacaaagatgatggttagccatggatccaggaatttcagtgtgtatgttcattagaacgattgatttttgggaggctgatttgctcttatactaattgtacttattgagcacgacgctcttttgttattgtttgagatggaatatgtatgttcatccacgatagctcaagatcaaccagctcttgacccttcacaatttacgaattcaatctgaaactgatctgtatttatattttnnna

SEQ ID NO: 10344 - DNA, 886 bp, Picea glauca
  misc_feature (45)..(50): n is a, c, g, or t
  misc_feature (753)..(755): n is a, c, g, or t
  misc_feature (757)..(757): n is a, c, g, or t
  misc_feature (766)..(767): n is a, c, g, or t
  misc_feature (797)..(799): n is a, c, g, or t
  misc_feature (801)..(801): n is a, c, g, or t
  misc_feature (814)..(814): n is a, c, g, or t
  misc_feature (845)..(846): n is a, c, g, or t
  misc_feature (868)..(875): n is a, c, g, or t
  misc_feature (878)..(884): n is a, c, g, or t
  Predicted polypeptide sequence is orthologous to G450
gtaataataacgataaggaacccactggatcgagagcaaattaannnnnnttgctactcgattcgttgaaacattaattatggcaaggttcaaaataaaatagccttcagtagcgtttaaaacatttaaaaaacacatagacagagtaataattattccactgcgtgcactcgttgtgaaatatggtacacagaatgcatattaatgacgtgctctcgtagtattgctgagtttattgatcgttcccaggcacctgaacgctgttcattgctgccactaaagaattacaagtcccaccattgagggacacagtgtggttgaggagcgtcctgacctgcttctcatcaaaacatttcaccatatccacccttcttatcaacttctgcaaaccccaagatgtgctttactcgcgcaccctcttgaaatacaaagccacatactctcacagtctcgcagttccagaaagcaggtcatgctccacctccacctctaatacttggacttggacttctccatggccctcggagctaaaccaatagcttctgaggccttcatgatgcgcaacctcttgcaagaatctacaaacatcatccagggaacatcgccaacaagcatccaatctccatccttatcttcgtaggtaggcacgtattctgatccactcagcagatccatcagcttgctctcgctcaggccaggggatccacattgtcccatggtgaagcagctgaacatcttctcgagtgcagaggnnngntccttgtanntgctgtaaattttaaggtccacctttctgnnntngggagctccatcnatgctcaccttcacatacaaagcattaccannaaacccatcgtcggtaggcttnnnnnnnncannnnnnntg

SEQ ID NO: 10345 - DNA, 900 bp, Picea glauca
  misc_feature (4)..(9): n is a, c, g, or t
  misc_feature (22)..(22): n is a, c, g, or t
  misc_feature (24)..(26): n is a, c, g, or t
  misc_feature (28)..(28): n is a, c, g, or t
  misc_feature (31)..(36): n is a, c, g, or t
  misc_feature (40)..(42): n is a, c, g, or t
  misc_feature (56)..(56): n is a, c, g, or t
  misc_feature (61)..(65): n is a, c, g, or t
  misc_feature (127)..(129): n is a, c, g, or t
  misc_feature (872)..(875): n is a, c, g, or t
  Predicted polypeptide sequence is orthologous to G450
accnnnnnnaaagggaacaaangnnngngcnnnnnngcgnnngcggccgctctagnactannnnntcccccgggctgcaggggatgcaagtcctttggctgaaaataataataataatcaggcgagnnncttgaatggaagggactatgtctttgtgtacgaagacattgaaggagatcgcatgctcgttggagatgtgccatgggagatgtttgtgaatactgtaaagagattgcgtgtaatgaagagctcagatgctggtcgtctagctaacaggacccagtgatcccgacactgcctgatgctgctggaattaagaaaccctaacaagcttatctctcaaagtaaccctaagaagggagatgagcccaaggttccctttttctgagagagttcacgagctattttatcctgctgcgttgtggactgaaacttgagggcagtttgtgtagcatatattggacaaaggagaaatcgatagaaaattgttgaatgcttcagttcgtcgagagataagtaagacggattaagcaaaataaaacagaaaattgtgtaaagctggctggtttggtccagtgagacctcgttccgtttatttttctggtgttgattgtactaccttgttcaattattgggtattcaggcctccattaaatgtttgctgttcaagataccgtgctttcctcagcgactctacaacattgtagagctccacgacgatctgtcaattctgacgactccagtgagaggctacaggtatgtgattggctaacagctcaaaccatagagtgccttctctcttcttctttttatatgtattattaattcccacatgtatattatgaacagtggtgttcttttatagacaatcnnnnccacatttataacagtaaaggaatt

SEQ ID NO: 10346 - DNA, 852 bp, Picea glauca
  misc_feature (4)..(8): n is a, c, g, or t
  misc_feature (21)..(26): n is a, c, g, or t
  misc_feature (730)..(730): n is a, c, g, or t
  misc_feature (732)..(732): n is a, c, g, or t
  misc_feature (771)..(774): n is a, c, g, or t
  misc_feature (813)..(819): n is a, c, g, or t
  misc_feature (832)..(836): n is a, c, g, or t
  misc_feature (841)..(845): n is a, c, g, or t
  Predicted polypeptide sequence is orthologous to G522
cagnnnnnaggtatccaagtnnnnnnggtacatcttacaaaagtctatcttctaaaatttagcagtgaattatatagtggtaatccaataacgttgcattctgactatggtcatagcatacagtacatgaccagttcatccactggtctactaaaagttgcatgatagaactaaagggatataaatataagttttaacacaattaatgtagctgcagggctataagtatccagcttatgtatctcactcactgtgaaattctacatgttaatatgatagctcacccagctagcttattcgtgtacaaatttgtctacattttacagagggctgcgagacttcactaatgatctgaccacatatttattgattgcttccatgtaactctgttggctgatttcttccaattgtcttctgcaccccctcaaggactgaggttgggttaatcaatcgaccatagactgcctatcaaatccgatgcttttagatgtaatttattatgtacatgaaaagccagttaaagttaccatttgttcatgtaattgttgtgggagagctgatcattttcctgcaaagctccagagatcaacatcacagttggaatttgaggcataatctccttgctgctcatgtttattagactgtcgcagaagtacagtcatatgatcaggtatgggatacattgtttcgttaggaaacctagcatcctttgacacgtcctcctggctcngntgtgaagctacaaatttatccagcactctccagtcagtnnnntgctcctcgttgtatgtgttaacagcgtgttgatcttcnnnnnnngctgctgactgtnnnnnggcannnnnatgatgt

SEQ ID NO: 10347 - DNA, 599 bp, Picea glauca
  Predicted polypeptide sequence is orthologous to G634
tttttttttttttttttgctgtcccttggctcatcgtagtcctctgatgagtctgaagaaaaactgataccctcgctggaattaagatctgtatttcctgcacttgttgtacccaccatgaaattgcctcctaaattattattatcctcatcttgtctagcactcataggatcttcatgagcctggactctaccacctccgttggatatggtactggcatcattcatggttttgttgctgttataaggaggtttgctattattgttagagtacaaagcttctagctggctgaaaaatctatagttttttccatcctgtcgtccaactcttccttccttggatcttttgtagtatttgtgaatgttctcaaatttttctttgcattttttgggatccctatgatagccaagctcctcgagtctccgtgatacatgctcccagagaggccccttgaggcttgcgtctcggaaattggcatccatttcagatcgaatcttgagaagagcgagagtttcttctctgggccatcgatttcctgcagatcctcctcctcctgctagtctttcacaatcctcaccaaccccaaatacatcatcatc

SEQ ID NO: 10348 - DNA, 869 bp, Picea glauca
  misc_feature (7)..(12): n is a, c, g, or t
  misc_feature (49)..(54): n is a, c, g, or t
  misc_feature (790)..(790): n is a, c, g, or t
  misc_feature (813)..(815): n is a, c, g, or t
  misc_feature (817)..(817): n is a, c, g, or t
  misc_feature (823)..(824): n is a, c, g, or t
  misc_feature (835)..(842): n is a, c, g, or t
  misc_feature (844)..(844): n is a, c, g, or t
  misc_feature (853)..(854): n is a, c, g, or t
  misc_feature (864)..(864): n is a, c, g, or t
  Predicted polypeptide sequence is orthologous to G634
ttataannnnnnatatatctagaatatgcaagtctcacagagtggtttnnnnnnggtggctgtcgtttccgcacgtctggctgagtggtggtttaatgctgttgatgctgctgctgctgcttaattttgagcttcatcggatagccctcccaattacatccattttctgctgccccagagaagaactgcacgcagttattattattggaggaggctccgggtgttgggtggccgttactgccattattgttattatcattgttgatattattgtgagtacaaccgccttcagatgatggcatgagctgtcctaggatctccacagcctctcggcgctcatcgttctcgtgactgcttgtgcagggttgcaatacgagttcgtcagtcgtggtctggtcatggacgccgtccggctggtttgatactttcgtactagtggatgtggcagtggtactgcttccgccgtttgagaatcccagagctccttgacggtagagtgaatcgagctgttgaaaataagggcaggtcttcgaattctcaggcctcttcctgttactgtccttggcttttctgaaatatttgtttatgttctcccatttttccttgcatctcttggcactacggtcgtatcctagacgagacatgttagtggcgatctcttcccagagggggcccttggcgccggcttcttgaaacctgcgttccatgttcgtacgcaggcggattaagctcataatttcaggtttcggccatcgtttgttgttcggatcgtaagtttctttttctctgntaaccatgtcctgctggtcctgnnntnctgganncatggtaatcnnnnnnnncngcggtgcgnntatttccggnagctg

SEQ ID NO: 10349 - DNA, 925 bp, Picea glauca
  Predicted polypeptide sequence is orthologous to G653
ttttttttttttttttttactttggaaacttttgcaaaccataataataaatactgccaatatcggctaaacagagttagcttccttttacaaacgaatataaattaaactacaagacattataccgcaatgtccctcacttagggttggcaaatacaattggtgaaattccaaagagaggatcaggtctcttttccccaacaaactagcataccgtgtaaactcttcaaaatacaaacacaaatgataatcaagtaactagatcacaataacgttatatctcagggactgcacttgctacctcagggactgcagctgctcgtttcattgtagcggtcttgatgagatgattgtaacttcccttttccttgaagagctgggaaaaatgatgcttgcaatacagtatgccttctagtgcagcataattagaagggctgattgaacaccccccatgagaacacttgaaacaagacttgtggtaggataagctttccacagtgaccttctcaagagggtatgctgtttttccacaggtagcacatttgtcttgagttccagagaacatcatggacactttactaggagatcttgtcagttcaggtgaaagtccatcaattactttgcttgatctttgggactgaaagttcttgttaaagttgccgctctctctgaaaagctggtcaaagtgaggcttgcaatatagcactccctccattgacgagtaattactcagcttgagcgtccccttgcaatggttacatctgaagcaagacttgtggtaagaaactccatccgcggacagttgatccacaaaataaaccgttttatcacaagctttgcacttctgctgcgttccggtgaaggccatagccacgatccgataatttttattgtaaaaatacggtcttgagccctcgcgttctaa

SEQ ID NO: 10350 - DNA, 652 bp, Picea glauca
  Predicted polypeptide sequence is orthologous to G663
ttttttttttttttttttggacgggtatttcctgattataaccgactggcttatgaacaaaagcggcttcttcaacctcattgtaaatgctatttgcagaggaaataataatagcagtggaggaagaagagatgatgagatcatcataacagacaacaatcacattttcagtatcaaacatacaagaatgtggacgggcatttcctgattagaaccgactgccttatgaacaaaagcggtaagggattcgatcaacttcatctccgccgatacagtacctgaatctgaacaagggcttggattttgtttcgtagaagatattagggttttgcccttgttcatagaattggaagatgtcgatcccttcttcagctcctcgtaatacagcaagcaataacttcgtctctttcacccaactggttgggtagcttcgtgcctttcacccaactggttgggatttagtggtcgagtcatacttacagccgtattacgctctgtcggtctaacgaacttcaatctgccaatgcacgcattggcatgagttttcttgctcaaacgagtattcaagcagttcttgataccgttatcggtgccctcaattagtgaccaccagttttccagcagtttatgaagtcttattataagctcttct

SEQ ID NO: 10351 - DNA, 861 bp, Picea glauca
  misc_feature (775)..(775): n is a, c, g, or t
  misc_feature (777)..(779): n is a, c, g, or t
  misc_feature (792)..(794): n is a, c, g, or t
  misc_feature (807)..(807): n is a, c, g, or t
  misc_feature (809)..(809): n is a, c, g, or t
  misc_feature (811)..(811): n is a, c, g, or t
  misc_feature (816)..(817): n is a, c, g, or t
  misc_feature (822)..(823): n is a, c, g, or t
  misc_feature (851)..(851): n is a, c, g, or t
  misc_feature (853)..(860): n is a, c, g, or t
  Predicted polypeptide sequence is orthologous to G707
caactctgcagcgccagtgtcaaagagttgcctttctgatgtcgacaaacgctccgacgggagatcttgcagctgttccgacacccagcggacgcagaagccttatgaaacttgctgaacgtatgacaaataagttttgtagtggagtgagtgcatcgagtaggcatacgtggaccaagttatctcagggcagtggagacgatgatgtccgagtaatgtcgagaaagaacgtggacgatcctggagagcctccgggagtagttctgagtgcagcaacatctctatggctgcctgtttctccaaatcgattatttgacttcttgagagaccagagatatagaagcgagtgggatatactgtccaatggaagcccaatagaagaagtaacccacatatccaacggaaaagatcgtgggaacagggtttctgttcttagtgccaaaaactctaatcagagcaacacattaatcttgcaagagagctgtgcagactcgtatggatcgatggtggtttatgctccagtggaaatttcagccattcatcaagttatgaacggaaatgactcaattaatgttgctctccttccttctggttttgtcattcttccagagggaccgccggaaagccgatctctagttgacaatcaaccagtcgaaggatcgctgttgaccattgcatttcagatactagttaacgatctcccaacggcaaagctgacgttggagtctgttgagactgtcaataatctcatttcatgcactgcacagagaatcanannngctctgcagaaannngatgtttgatgtncngngatcnntcgcnngctaacttactatctcttcaattatttntnnnnnnnna

SEQ ID NO: 10352 - DNA, 727 bp, Picea glauca
  misc_feature (2)..(7): n is a, c, g, or t
  misc_feature (10)..(14): n is a, c, g, or t
  misc_feature (651)..(653): n is a, c, g, or t
  misc_feature (709)..(709): n is a, c, g, or t
  misc_feature (717)..(719): n is a, c, g, or t
  Predicted polypeptide sequence is orthologous to G707
tnnnnnngannnnntgcaattaagctaaataatatcaatgccgtcatgtcatcatgtacatgaatggatgattgagtttagctgaaagatgagagtaccaaacgatttaagattttgcggggagtcaatacccgaaccactacccttgcatggtggtaaagcttatgcaaatatcatttgtttgtttgataattgcattgagaaggaaagaagctttagtttctgtctgtctggttttggtttcatttaccacttggcaaggatatatgtggtgcgttcttgactccacgacgcatccttcatgaatattttcagttacatatatcatgtaatcccagtaatcccattgccgtccatccgaggacaaaggtgaaagcaggcagaaggaagtggctgtggctgttgctgtgagggacaaatcaacacccagctcaatgcgagcaaattggtgttgagatcccctcataactgcccagttccaaaccccccttacctagcacgttaaacattgattggcatggactaaacaaaaacaaaaaagctgatggggacacaaaaaaactagacagcgaggattaagagggacatttatgtcaagcatcttcacagtgcagagctgccttgattttctgcacagtacaggatatgagnnnattcaccgtttccactgactccacagtgagtttggctgttggcaagctgttgactnatatttgnnntgcaactg

SEQ ID NO: 10353 - DNA, 633 bp, Picea glauca
  Predicted polypeptide sequence is orthologous to G732
ttttttttttttttttttctttgaatatacaatgccccttaaataatccatgacatggtttacaatacccctaatatgactccaccgaatttaagctgtttttacatttgccaaataccactcaaccatttaatcaaaacccattttgtccatgaaaggagaaagcagatacaactgaaacctaataagataaacacaagggagtattcacaacgtacacattgaatttgggcctcagaacaagagatcggaagagataaaggaattagcaatggtgcctgattccaagcttagatgtgcagcactgcaattcccagtttcaatacccgtagttttaaagccaccatgtgattgggcatttatcgtgtgctgtaatatctggagctttcgactcagctcctgtgcctgcgatctcaagaggcaattctcttctatgatatgagcataatgccgtgaagcaatattgaatttgtctactatctctccgttctctgttctcagaagagccacctgcgccctcaactcgtccaagtgatgttgtttccggagcctggaccttcttgctgattctctgttagacaacatccttctctgcttcctcacgtctatcacttgctgaacctctgcttcatc

SEQ ID NO: 10354 - DNA, 835 bp, Picea glauca
  misc_feature (756)..(760): n is a, c, g, or t
  misc_feature (786)..(790): n is a, c, g, or t
  misc_feature (820)..(825): n is a, c, g, or t
  misc_feature (827)..(833): n is a, c, g, or t
  Predicted polypeptide sequence is orthologous to G732
ataagctttgcagtaggatgtctcctcccccttcgtattccatgtttcccaattcaggaatgggcttaaatccctcagtgacatcttcagaaccctctagtcaggtctccggatcgatcccccatcattattcaggctccgaggaagacccaaaacagacgattgatgaaagaaagcagaagagaatgctttccaacagagaatctgcaaggaggtccaggatgagaaagcaacagcacttggatgaattgagagccgaagcagctcatctcagagcagagaacaatcatatgctgacaaaattcaacattgcttcacacaaatacatgcaactggaagaagagaattctcttctgaggtcctatgccacggacttgagcctcaagctgcaatccctgactattgcaatgcagtgggctggagtgctgaatgatatggatctggatagtagcactggctttatggatacaacggatatcaagtcttgttacttgccttccatttcacagcccttgacatcaacagaaatttatcaatagctactcatgtgtctcgaacatatcaattagcacattactcttatctgccaatctgtatagttttagaatttgttgttataagcgaagaatggatctgagaaagtgaggaatgatcctatcaggcaacatgatgaccacattgcttgtttgcaagcttgctgtgatgtaagatagtgtaggatggatggagaaagaactagttataattcattctttnnnnngtattgagccctgcacagatttattnnnnngtctttgtctgatgtaataatctgcatttnnnnnncnnnnnnngt

SEQ ID NO: 10355 - DNA, 840 bp, Picea glauca
  misc_feature (768)..(774): n is a, c, g, or t
  misc_feature (809)..(813): n is a, c, g, or t
  misc_feature (815)..(816): n is a, c, g, or t
  misc_feature (819)..(837): n is a, c, g, or t
  Predicted polypeptide sequence is orthologous to G896
ctcatgctcattgaagagcaaagtgatcctcttagaataccaacagcacacaatatgcgaatggctctatattggcttgtgcaaggttgtcagcctggagattcattagtgttccattactctggacatggttcacaacaaaggaataacactggagatgaagttgatggatttgatgaaactcttcttcctctcgactttgaaacacagggaatgattgttgatgatgaaatcaatgcaagaattgtcagacctcttcctcgtggtgttagacttcatgcaataattgatgcctgccatagtggcacagtattagatttgccttttctatgccgactaaacaggagtggacagtatgtttgggaggatcaccgtccacgatcaggtacatggaaaggaacaagtggtggagaagccatctccttcagtggatgtgacgataaccaaacttctgcagatacttcggctctctcaaggatcacatcgactggagccatgacatactgttttattcaagcaattgagaagggagctggaacaacttatggaagtctattgaattcgatgcgtaataccatccgtgaaacaggggcaggcactggtggtggtcctgtcacttctctcataactatgcttttaactggaggcagctacagtggtgggcttacccaggagcctcagctgacatctacagaaccttttgaaatccatactaaaccattttacctttgatggtaagctgaatacatggtgaaatgtagcttgtgnnnnnnntctgtttagtgcttccttcttttatgttcaatgannnnnannggnnnnnnnnnnnnnnnnnnnctc

SEQ ID NO: 10356 - DNA, 554 bp, Picea glauca
  misc_feature (8)..(16): n is a, c, g, or t
  Predicted polypeptide sequence is orthologous to G937
ctcatttnnnnnnnnnatagcaagctattcaatttatttcaatccgaatcattgctctctggcaaatggaatcagaccacacaaatatgagtggctgttatcttacagaaaattatctgataagggtaattgagttctgatttcattgaaaaccctattgagtcttcgtaactcctgcacatgaggctcatcatcttcgactggaacaattttcgcaaactgtccttccccaaagtagtccaccactctgttggcagcttctagtccagtgacatatgccttttcctgagaccaagaaccatgtcgagttataacccaatcaccagccataaataagtttggaatgctagtatttccacgcatcatgtatcgataagaacctattgtaaactatccgttgtagtgcagtgatgccaacagcaaatatgacagcatcagctgtaaatatcttgtctccacaagctactgctgatattgttccagtattctcatccagcagaaaatcggttactcttttatttgcaagaaattgacaacctcgtgttttcatgaac

SEQ ID NO: 10357 - DNA, 871 bp, Picea glauca
  misc_feature (780)..(782): n is a, c, g, or t
  misc_feature (784)..(785): n is a, c, g, or t
  misc_feature (787)..(789): n is a, c, g, or t
  misc_feature (839)..(839): n is a, c, g, or t
  misc_feature (841)..(848): n is a, c, g, or t
  misc_feature (854)..(859): n is a, c, g, or t
  misc_feature (861)..(870): n is a, c, g, or t
  Predicted polypeptide sequence is orthologous to G979
gaagcccgcattggtagagttttaggcaacaagtacctctacctgggaacattcagcacccaagaagaagcagccacggcctacgacagggcagccatcgaataccgaggtttgaatgctgtaaccaactttgacttgagccgctacatgagctttcttcgtccagcgaaagatttaataaatggcgatggagaagatgttgttgtttccaacgaggactccggaacgagtctcgtccccggtggcgtgtccaccaaatcctcgaacgacgaggacaacatgtcttcgttgctgcagcctcagctttcttggacgcccccccaactcgaatgcagtaacgaagaaaaggaatcgtccagtgcagcggatcccactgacttggaccatctttttgctcagtcgtcctcaaaattcaaggaaataatggaaattagaacttcgggccaccagccgggagaggatttgcacaatatcgaaaccgctaatttcgcagaagatttggagatgttcttcaactccaacaatatgctgggctctgatgcggagttgtctcttaacgtggattctcccagcgccatgaataatatgttcgtccaaccagatcacttgcaccttcaaatgcccttcgacatgcatgagatctgtaacggcgaattccttgatctcgaccaccaccaacacgccgaccttgaatatcccctgatagatcccatttcttcttttcctaattttgtagtcaggacttgttcctgatcaattccagccaataaccacagaagnnngnngnnntagtcatatgtatgcaattaatatgccttgattcctctcttctttgtcantnnnnnnnnagttannnnnngnnnnnnnnnnt

SEQ ID NO: 10358 - DNA, 812 bp, Picea sitchensis
  Predicted polypeptide sequence is orthologous to G1006, G22, G28
ttttttttttttttttgaaaccaaatctgattgttaacataacattcttaaaagatatacaatgttttacagcgctctaccaacataaataagtatacaaacttttggtacatttagaaagaatagatacaaattctaggcttgtacagaaagaataatagaattttttgtcctttgaggaatggatagaaaaaacgcagggaagtcctcaattcaccatgagttgtccagcggagaggaaaccagtgaagctcatgtcgatgccacttggtgtgagtggcggcgttgccagcttcccacccaaaagctcttcaaccatttcgtgatccatcgtgttgctatcttcgaatctcactcgacattgtctattccactggacttcaacttcctcacgttgcctcttcttactcaaattactctccaccttttctatggtggacgtattattattacatgtattactgtcctccgcgccaacttggagggggaaattaagcagagccctagagcccctcatcttgtaagcggcacggtcataagcgagcgcagcttcctcggcggtagtgaaggtaccaagccaaactctagctccctgccgcgaagagtcccttatctccgccgcaaatttcccccagggtcgctgcctcacgcccctgtaatgcctccccgcattgttcttcacagtcggcggcggcggcggcggcggcgtggctcccgtttcttgacggatatccgcatctggtttgacgggcaaagccgcttccttcttgatctccgtcaccggctcttctttgggcgttcggggcagccat

SEQ ID NO: 10359 - DNA, 877 bp, Picea sitchensis
  Predicted polypeptide sequence is orthologous to G1006, G22, G28
gacagacctaaatttgtgcgtggatttattaggtcccttggaattcttcttaatttctcaggtttccacattgcagaaatgaacgtcctcgatcagattcggcaacatctgctcggggaatccgacggctcaccttcgttctgcaccggatcgccggcggagtcgtgcttgacggaaaattacgcgtcttctaacagctggaacgcctcggatgaactcgactccggcttcgtccaaagcgcgctggtaagcgatttcgttgaagaagaacagacggcgacggagaatcagccatgcggcggcaccaggttttctcgtcctgtgctctccgtcaccgttccgcggagggaatccttcgagtgggagagacgttccgttagctggggtgtggattcaaggaatttcgtcacggcttgttgcccggcgtccatcagacggtgcctttcctgtgagtgggggaagcttccgttggatgaaaacgattcggaggacatggttctgttaggggttctgaaggaagcgacgcagaagggctggacgccgttaactccgaaggaaatcaagaacgctgacgtcaagaaacagataaacccccggcaggaaactggacataagctgtcggagaaggagaagaagagcggggagagacatttcaggggtgtgaggcggcggccgtgggggaaatttgcggcggagataagggactctgcgcggcagggatctagagtctggctcggcaccttcgacaccgcggaggatgccgcttttgcatatgaccgcgccgcttacaagatgagaggcacaaaggccttgcttaatttcccccttgatgtggtttccaagtccatggataccctcaaagaggatgaaagttgct

SEQ ID NO: 10360 - DNA, 794 bp, Picea sitchensis
  Predicted polypeptide sequence is orthologous to G1006, G22, G28
gaggaaacggaaatcaatcgatgataacgtgattgtaattgtgactgagcagagacaacgatggacgttgcaggaggggtgagcaacaacataaacatgaaaatgttgaatatgttggagttgatccgccaccatttgctggatgtggaggacgaaatagatattatagatcttcaacgaggaaatcaagtcctcgccagcggcagcagattaacatcagatggcaataaattcgcagaagcacaagattactcctcgtcttcttctgtatgcccagttataaggagagaagatgcgtttaacgtaaagccacaggcacacgacgaggacaatggagagaacaagcagataagcagggccagccactacagaggagtcagacggcggccgtggggtaaattcgcagcggaaattagggaccctgccaagaaaggggccagagtttggctgggcactttcaacaccgccgaagaggccgctcacgcatatgaccgcgctgccttcagaatccgcggagccagggctctcgttaacttccctctcgcctttgcttccaattcagagaatggatcagccgtaagtcacatggggcagaagaggaagagaggaaatggtggcggcgggacactggatttgggggcgtgtggttggataatggaaaaattaatatgcctttcgtgataattacagtattattatgattacgtgaatgtatttacgaatatgattatttaaatattctgattatgagaatgtcagtttgagattgctataattgaaaaaaaaaaaaaaaa

SEQ ID NO: 10361 - DNA, 360 bp, Picea sitchensis
  Predicted polypeptide sequence is orthologous to G1006, G28
aaaattgaaacatttattttatttgccctttgtaacagggaaaattataatccaaacattttctgattctcctatcttcaatcttacacagtacacaagggaaattaagggtggagatgatgcagggggcttcagctagaattgctggatttttaccagttatcgaaaatttatcgtattgctacctatctcagccatacattatttatccagctcctctgtccgactccttcaatccaacgaccatccagccgccccactgacactgtttgctctcttcctcttgcgacctacgcccgatccgttctctgaattggaagcgagggcgagggggaagttaagtagagccctagctccgcc

SEQ ID NO: 10362 - DNA, 830 bp, Picea sitchensis
  Predicted polypeptide sequence is orthologous to G1006, G22, G28
ttttttttttttttttttaataatatttatggtgaaataacactcattaaaattataatcttgatctttttcattacaatcctgcaaagaacgaaaggggattaagggtataatcttagtttttattcattacaatcctcaaagtatgcttttcacaaagattgttggaatattaccaattcaatctctactataaattttcataatcataatcataggataggaacattaaatttatcgacgctcatccattgcccgatcttcagcttccgcttccactcccactcccgcagcccttccgactgcatgccgccctctcctccgccgtttcttctttacctctcttcctcttgtgcgccatgtgacctacggccgatccattttctgaattggaatccagagcgagggggaagttaactagagccttggctccgcggattctgaaagcagcgcggtcgtatgcgagagcagcctcttcggcggtgatgaaagtgccgagccaaaccctggcccccttcttggtggggtccctgatttcggctgcgaatttaacccacggccgctgcctgactcctctgtagtgcctggccctgctcatctgcttcatctttacactctcctcctcatgtgcctgtggctttacctttacatttaccgcctcttctcttcttataactgcggattcagaagaagtagaagatgaagagcgttgtgtaaagtcattctcattgtcggtggcgtggatatagtcccagctgctgccgctggcgacgactgctggggagaaggatactgaggatgggtgattttctcctacaggatccagatct

SEQ ID NO: 10363 - DNA, 559 bp, Picea sitchensis
  Predicted polypeptide sequence is orthologous to G1007
ttttttttttttttttttgattattagtgtgtcctagaagcaagaacgtgaccaacttcaatcttagattcgaagatagattggaaggccctactagctttgttccatggaagtgtccattgcaaatgctcttggagaaccacgaactttaggatcttgtatagaaggtcatcacacctcccacaaatgttgcttgttggcagagcataacaagaagatgaccaaggtgaagcaagtcatccttgactcagtgaaggatcacctgatccctcacatctccaacaagaagaaaggtaaggagatgttttatgttgtagtcactctatatcaaagtgggaacaagagtccaaagattctcttaacaaatcaactcagagcaacctttttgggtgtcaaatggtatgtggatagtggagcttttgaacatatgacctctaacaagaaggccttcaacaaacttcaagagcaagaggtacgcatacaagtgaagcttaatgatgatgccacatatctagtagcaagagtgggatctatctcattccaatgtcatcaagtgatc

SEQ ID NO: 10364 - DNA, 877 bp, Picea sitchensis
  Predicted polypeptide sequence is orthologous to G1033
gctcttcacattccttgccggtcatccatcttgttcatttctacttccgccgctcctcttcgcttccctcgtctcgtgtgttccttgcgttgtgtcgtgtaatgtttgctgttgtttcatatcatcgcataaaatagtggtgggatttcccttcactgcacacagatttttttttaaagagaagcagacacaggagggggaggtgcaaagttggtttgcatccaatttccagaacgatgaaggatgcaaaggctaagaggactgcagcaaaggacactaagaataaaaatgctgaagccaagaagaagcttctcagtgccaaagagaagccaaacaagaggcaggccaaacccaaagcagtaaaggatccaaaccaacctaagaggccaccaactgctttttttgtatatctggaggagttccgtaaaacattcaaacaaaagcatcccgatgtcaaaggagttacagcagttggaaaagcttgtggtgacaaatggaaagaaatgagcgaagctgaaaaggctccataccttgctaaagctgcacagaagcgagctgaatatgatgtaaccatgacagcatacaagaagaaacaggaagtgggtgtccaaagtgccacacccgaggaatctgaaaaatcaaagtctgagctcaatgaagatgacgaggacgatgaaagtggggaggacgatgatgaataaccgccgaacacgtaagcagcactaaattttccgtgggggatgatggtcttcaagctctgacgagagttttgttatagtttgagatcagaagatttaccagcagaattatacccaatgtttaattgctcattttgtatagcagctgatatcaagaagtttgttgagctcattttgtt

SEQ ID NO: 10365 - DNA, 878 bp, Picea sitchensis
  Predicted polypeptide sequence is orthologous to G1033
ttttttttttttttttgccacaaactcccatgtaatattacataattactcaaaatattacataaatgataaaaacatccaacaatcatttgccatgcactttagatgacggtttagatgataaaataaaattccagaaggcctacctctggtcatttccatttatgtgcattgtcaacccatagttcacatacaaagcgggacatggcagacccgacaccccgtgccacatcaatacatattagtctcatgttaccactcccccaattacgcatgcttcaaaagattagatacctcatagcatttggctaaacccccccacacatgcacagaggcatccgttacaatattatgcccatgaaaccccacaaaattgttctcttaattaaacaaatccagcaatttctggacacacctactcctcttcagcctcaccatcgccattagaattagcctcttcatcattaacatcaccatcagcatcagattttgctacctcgtcctcaccaccatcactggatttagctgcctcatccttgagatcttgttggtatttagacatggctttctcatactctgcctttagttcagcagccttttccaggtatggcttcttgtcctcgtctgacatagccttccatttcaagcccccttccttgccaacctgggcagcacccttgacgtcaggattagtctccttataggtcttcctaaaatcatccatgaaaacaaaaaatgctgtagcaggcttcttcggctgattaggatccctagctttcttctccctcgtgcgctttttcggcttctcatctgcagactttttctttgcctttttcgcttcgggtggcttctgggcatctgcgtgtttggtttctttg

SEQ ID NO: 10366 - DNA, 890 bp, Picea sitchensis
  Predicted polypeptide sequence is orthologous to G1033
tgatagaggaaaatagcaaagcgagatttgtgtagctgcgtttcgactctgttacagacgaacgttcgaggttccaagcccacgcgttgctaaagcaagtgctttcttcgatgaagggaggcaaagcaaaaaacgaggcgtctagtacgctgaagaaagtcgaggagaagcctattgggaagcgaaagactgcagcaaaggaatcgaaggtaagtagtaggcaggagaaaaaagggcgcaaggcggccaaggatcccaacaagccaaagagacctgcgagtgccttctttgtatttatggaggacttcaggaaaacttacaaggaaaagaatcctaatgtcaagtctgtatccgttgttggcaaagctggaggcgacaaatggaaatcaatgtcagaagcggataaggccccatatgttgccaaggctggcaaaaggaaaaccgagtatgaaaagaacatggcagcatacaacaacaaacaaactagcactgcaggtgacagtgctgaagagtcagacaaatctaagtctgaggtaaatgacgaggatgacgaagaaagtggagaggatgatgatgcagagtaaatttctcaaaggcttcgcctgaaatggctttgtatcagtgccattaagttggaagaatttgtaacttgactaattagctgctggtagatgattttgttatttcctaccttttgtagggggcatatatgaaggagatttgatcgctggaagtgtatgcctcgggtagttccatatgtgtagttattcatgaacatgttattgactgctgtgatcatgttattaatgtttttaaaaacatggtcaggtaatcgtagataagatgttttattatacaactttcagttggttattaaaaaaaaaaaaaaa

SEQ ID NO: 10367 - DNA, 796 bp, Picea sitchensis
  Predicted polypeptide sequence is orthologous to G1089
aagacctcttttttttttttttttgtgatgcaatctttttctgatactcaattttcataagctcacctgccttcacttcatcataaagtttattttcccatgctaatagtttgtccaatacagaggcatgggtctccttctccttgccctgcatatcatcattcccatcttctaagccatgtgggcctttaaatgacctattccatgttataacgcgcattacctgttctgaatgattaattgtacctttattatcggcgaaattggagtgatagtgcaaccggttcgcttcgagcatcttggagaccgcaaggccgctctcggaagccacgaggaactgatcatcgatatcctgtaacacctgcagcagatgcttcccactgcctctacctccaactctgttcggggccacggacagctgcatgtcgttgcccgccttctcggcgatcttgttgtccaccacgagagcagacttttccagttccttgatcggatgcttgttgtaagagtcactgtcggtgtcggtgtcggtggcggcctcgtcgtggctgaggctgttttgctggtcctggtcctggtcggggggctccggttcgtccactgagggtcggtgttcgtagtagttattggtattattatagtcaaagaattcccaactactctgctgcgtgggaggcggaggcggcggggcgtcgttggagggcggaggcggaggcggaggtggatgcggcgaaataacggcctcggacacctcgaccgcatgctcctcctcgtcgtcttcttcgtcttcttctcc

SEQ ID NO: 10368 - DNA, 818 bp, Picea sitchensis
  Predicted polypeptide sequence is orthologous to G1136
acgattctgccatcctgtatgttggacttagcctgctgcagctgcggctgctgctgtttctctttctcagtttccatatccttgactttattctggagttcctgaatgtaagaaatcgcatctcctaataatgaagctttgtccatctttgagatgtttggcaccacagctcgcaatgcataaaatcgttggttaagcttctcacgtctttggcgttctgcttcaacatgattgaggggctcttctcttccattagctggtttcctcccccttttccttggtcttctctcttcaaccaccacgggcctacgctccgaggcttccacatccgagtgttcctcggactccataaggggcggtcgagcagttactgcacttagggaagggccagcaacgctaattggcgaaattctgctagactgttttatcagatcacgagtattataaatctctccaccctcaccattactgatatggctccagtttggtgattgcaacccattctgattggcatttgtataagatattctctgttcgtttgttacatagggagcagcatgggaataaggggggcggaaaacggggtgataatgacgatctctctcttccactttggtgacaacagattcgctagatttgctgagttcttgcccaaagattttccaatcatgggaaggctttagaggtggagcagccttggcattcacagcattcaccctaattggatttggtgagaagggtgcaactagagaacccttcaccgttggttggcctcgatttccatcacaggcattttcattgaaactagatctaatctt

SEQ ID NO: 10369 - DNA, 853 bp, Picea sitchensis
  Predicted polypeptide sequence is orthologous to G1140
ttccggaggataacgctttcgaagtacggtgttgaattatctcgcttgactgaaacattttagggttattctccacaagcccagttttcttgccctttaatcttcttgtaagccttcggatttggcggaaaattttcccttccctgtgtatgatctgtatgttaatagcgagacatcttgcctgttgttgtaatctcagattggagtgacatggcccgcgagaaaatagagttgaagagaatagctaacgcttcggccaggcaggtcacgttctcgaagaggcgaaaggggttgttcaaaaaagctgaggagctatcgattctatgtgcagcagatgtagccctcattgttttttcttccactgggaagctgcacgactactccagctccagaaatatgcatgggaaagaacttgaaggattatctctaaatgacttgcaacaattagaagaacaacttaagatggggttaaattgtgttcgattacaaaaggatgaatatatggttaaggagataaatgagcttcaagataagggaagacgaataacagaggagaatacagaactccatcgacagattacataaatcgcccaacaaagactatgaggattctgatacttccttgcagctggggttatcttcgcagtcgaaaatttgagactcttgcgtcgtatttcaagagctgcttcatatttctattatggacagttagccttctttattatggacagactgacctgaatatactctcacaccttccaacccaagtgttttttataacagtttgcccagatgatgttatatataatcaacataatgatttaaacaggttgtaatatgcaagaagcataca

SEQ ID NO: 10370 - DNA, 785 bp, Picea sitchensis
  Predicted polypeptide sequence is orthologous to G1140
gattccttctctccaaaggcgccgcaggagcgctcgctctcgctctcattgttatcatcagaagcttttacccaccattcagcgctttcagcatgaagcgagctttggataataattccaagggtcaagcaaaaagtaggaatgagtgtggtaatgaagaattgataaatctccatcgagaaattgaaggtttacaacggttgattagtcaagtgaaaggcgattggcttgatggtcttggattaaaagagcttcaacaactagagcaaaagcttgaaactggattgactcgtgttagatcagaaaaggaaatcaagttgcgtgaggaaaataaaaacctacgtcgtcagataaaggagttatgtggaaaagcactccaagatcccgagtcatctgaatgcataagcaatttggaagcactccaagcttatcttgaagaatcttctgagtccgatacttctttacagttggggttgtgaaggtccatcaaaaatacagtaaaagtgcttcaatgggggcatactgcagacatatcatacaaactaattctctttgatgacatttatggaatatagatttatttaaaatatgtatatgatacagacattaaatataaatatatgcttgagttgcttgcaactttaagtgagtaattccttacaatgttagtgatattaaatgcctaataattccttacaatgttagtgatattaaatgcctaatcaataattatggattgcattccttacaatgctaatgctattaaatgaaaaaaaaaaaaaaaa

SEQ ID NO: 10371 - DNA, 730 bp, Picea sitchensis
  Predicted polypeptide sequence is orthologous to G1198, G1806, G558
ttttttttttttttttttacatgaaatgaaacatccaccctcagctgatattgattcatggaatgacgaagatacatctgagtgtggccacccttcttttttataaatatgtacagaagtatctcggtgtttcatgcttcttcagtggtcaaatttcaactagtaatttcaaacactacctttctgtaaatcatgactaagaattttctatctgcaagcctgattagtagcatgcaggtgtgtaaagtcactgatcataaacatcaatgctgaatgttaatgttgcgtttagcatgagctggagactctgctctgctcagagcataaatcgaattaacaatacacaatgttgtgtaaatttctaatcctaaaacttgggctgatcccatggtagtaacttagacatgcagtgcaaattatcacgaaaactatggaccgaacctaattaattatccaataaaggcattggaatccacgaggcattgagctgatgatctgcaaagtgattaatactcattctctgggtctagctgaccaaagagagctcagtgcacgaagtcgagagcagtattctcctattgaaagtaagcttttggctgactggcgcgtggtgaggattctgtgcagctgttgcaatgtctgatgtctcagactatccgccaagatttctagattggcaagttttcccatggctatggccatttgtcccatataattggccatgtttgaa

SEQ ID NO: 10372 - DNA, 135 bp, Picea sitchensis
  Predicted polypeptide sequence is orthologous to G1228
ttttttttttttttttttacatttcatagtttaaaccattggttaatggagtacagttcgatatgtcaattgtacatttaaatgtcacaaccatgggccaatgccaaatggactacagttttaagaagttaatgc

SEQ ID NO: 10373 - DNA, 259 bp, Picea sitchensis
  Predicted polypeptide sequence is orthologous to G1246
ttttttttttttttttttcgaacgaatagtaaccaacgaatctttctgataattaataataaaagaaatggtagtcaacaatttgcaaacaaaaactctatctccggaaccccgaagaaacccgctgcttctgcttctgtttttttatttttcttttttccttcacaatacccaaacccaaaaactcctgctctgcctctgtataataccaatcagcctacaacaagctcaccacgccaatattttttaacttatgacc

SEQ ID NO: 10374 - DNA, 465 bp, Picea sitchensis
  Predicted polypeptide sequence is orthologous to G1335
ttttttttttttttttgacaaagagcacggctttattacaaacttcaattgcacgcgctacctacacaaatatatagaaacttaaggcgggtaaggcggtaacggcccataagtcgcgcgggagccaggcggctgaccgccatcgccatagccgttcttagtactaaccaggcggcgaaccatatccgctataatccttccagaatagtactcgccatcgccacctctaccagaacccgaacgccggtagccactcccggcttcaccgtagctgccaccgctgccagaaccggcacgggaagattcgctgtggccatatacatggccagtacagagaaacagactcaaagcaagcacaaatatgcagagaaatttagtcatgctggtcgccattatcgattatatctacgatattgagcctcgggcagagctagtttaagcgctgatcgggggggggggggatta

SEQ ID NO: 10375 - DNA, 852 bp, Picea sitchensis
  Predicted polypeptide sequence is orthologous to G1335
ttttttttttttttttttaccttattaaagagtttaaaaaacccaagacagagcaacagtgcctagtagaactaaaggagatcaagcaggatgttggagaatctatctaggactatgaccagaggttcaaggacttactaggcaagttgaccttcagaatacaggacatccaacacagagaatggtttattgctggattgttgccccacattcgcatccctcttacacagcaaaagatttcctcccaggaagacgcgttggagatagctataaggttggaatccacaccaggaggactcgtcgagccctcatcaggcttggcgcaggtgcataaccaactggccaccttgaccaaccagctgcgggagatataaagaggaaaagcagtccgtaagaaggtgtggtgtactctgtgcaggacagagggacgtcacagaaatgagtgcccactccttggaaactataatagtgcgacaggcgcgttgaatccatttccctacagaggaacctctaattggtgcgatatatgtagagcttggggacatgagcctactcagtgtcctatgttgcagaaatctcaaacttccactaagacacccttgtgtgatctttgtaagtctatggggcatgatgtgaacaattgcagatctttggagctgatgaaggagtgcacatcagatgcttaccgtgtgcagggaacataagacaattcgggagcaggacggggaggcttaaaaggtggttacagaggtcgagaacgaggaggtgcatccacttgttataattgtggggaggttggacacatttcctgattctgtactaaacctcagccacggtgcagacactgacgcc

SEQ ID NO: 10376 - DNA, 719 bp, Picea sitchensis
  Predicted polypeptide sequence is orthologous to G137, G145
ttttttttttttttttttatcaaactcattctataaacatattttatgcgcttgttcacatctgtttatagcagcgttttgtaattgtccgagtgatatacctattacaaattcactaaagtcgggcgattcaattgacgagttaccaccctccatattagcggactggaaaataatacacctaacatgtactgaatgaaagtttcaaaccctccaaccctgcgcttcgtaatttcgcgattgcctttggccggtggtagtgcttccactaggggccgacggacgccctatatggagagtcgggttgcagtgcggtgagtagacttgagtgtcatagtttcctgcagtagagtgccacgacccgcggaatatttgtataggatactgatcacatggatattgtccttccaatcccgaaaacttcttatgaagcgacttgtttattccctccagcagctgttcctttctttgtagttcttgaatcatgtccaacataaactgattctttttcgatgtgatctgttttaagccttcttcgagttgttgctcaagttgttgcaactccttaacacttagtgattcaaggtcttcacccaaaaaatgccttctccgtctttctaagctttcaaccttttccttcaattgcgtcaactccaagtttgaagtctgtgtatctttgttgttatcttgtactgaatttgaacacttacgatgccttt

SEQ ID NO: 10377 - DNA, 738 bp, Picea sitchensis
  Predicted polypeptide sequence is orthologous to G140, G146
ttttttttttttttttttattgcaaattattttttcataacatattgccttctgaatatataaacataggatagatcgtcttactccttaattatacaaataataaagttggtagaacccatgttttgaagttataatgtgccacacacggaacacatttacaatgcaatatatattacatctcaacgttagaactaagtgagtgagtacttagatcaaatccacaaggaacatgttggttaggtaataaagttgtaaatccatgtgttagaagtgaggtaattcccttgccatttgtacattcgtccaactttccttgaagcatcatgttgctcatccttaacgtatgttccttattttgaagggttttaatctcctcaagcatgagttcattcttttttgatcgtacttgatttattcctttttgtaaacagcattctaattgatttagctcctcaaatgtcacagaaccaagcccttctcccatcaaatatctgttagtaagttttagctgatcaatttgttgtttaagtaaatttatctcttgcttctttttctcgtccgaagtaccatttgaaaagttgatatgttttgcggtctgtgagcacttttgatatctttcgagtatcggccttatgcttctgttgctgttgttgttgctggtgccgagctcgtacagctttcctcggctggagaaaacaatgagagctacctctgcatcgcacagcactgaaagct

SEQ ID NO: 10378 - DNA, 408 bp, Picea sitchensis
  Predicted polypeptide sequence is orthologous to G1419, G43
ttttttttttttttttttggaaaaacggaggaaagacctcaattcaccgttaattgtccacgggataagaaaccagtgaagctcatgtcgatgccactgggtgtgagtggcggcgttgccagcttcccacctaaaagctcttcaaccatttcgtgatccatcgtgttgctatcttcgaatttcactcgacattgtctatcccactggacttcaacttcctcacgttgcctcttcttactcaaattactctccaccttttctatggtggacgtattattattacatgtattactgtcctccgcgccagcttggagggggaaattaagcacagccctagagccccttatcttgtaagcggcacggtcataagcgagcgcagcttcctcggcggtagtgaaggtaccaagc

SEQ ID NO: 10379 - DNA, 558 bp, Picea sitchensis
  Predicted polypeptide sequence is orthologous to G1435
ggtcagcagcagcaacgtccaggggtcgagcctccgaaaaggatcgaattggaggaggaggagtcatcagtgggaggtgtgacagagaacgtgggagaggagccagctcggacgctgaaacggccccgattggtctggacccctcagctccacaagcgattcgtggacgccgtcgcccacctgggcatcaagaacgccgtccccaagaccataatgcagctgatgaacgtggagggcctcacccgcgagaacgtagccagtcacctccagaaatacaggctttacttgaagcgaatgcagggcttgtcctccgagggtccctcttcatgcgaccagctcttcgcctccacacccgttccacccagtcatttcctgcacagggacgacatggtggtgcccctcgttcccatgggtatgggtgttccaggattgggccacggtcatatggtgcccgggccaccgcactacgggggttttgatcccaggtatcttactactctctccaggcagcaacagcagccgccccctccacagagactgggcccttctgctgcaact

SEQ ID NO: 10380 - DNA, 575 bp, Picea sitchensis
  Predicted polypeptide sequence is orthologous to G1462
ttttttttttttttttttaagaaacttgattgctattagtttctagaacttcacagcatatgacagtggatttcctcaaaaccttgctgctttaaagcaattgtcgcattctgcatacgacttataattctacatatgatactgcaacttcaaacggaaccgcagctcttgttcaatagaaattacagctggcatcaaagccatattttaacttttacacacgtattcaataaaaaagaatttatattttaagcctctatggatcaaattctgaagaaatgggctaaaacaacttccggtagaaagctacttgagacggtgatcgatcactataatggaaattttgatcttcggcatttctatggccccgttatttaaagaaatgcaccaaatatctacaaggatggcattccagaactatagaactcatattatggaaaaagggtcgttttgcaaccctcatcatccagaggccatcatttgcgagttaccaggagttacatttttaatgaaaaactcctcgagtttgtctcaagcaaacagagattttttcctcaagctgagctatttcgcta

SEQ ID NO: 10381 - DNA, 862 bp, Picea sitchensis
  Predicted polypeptide sequence is orthologous to G1480
ttttttttttttttttcagattaaaatttcattaaattacagggaaaatagactttaagtaatcacatggtacaaattttacaaaccagactaggccggtaattagtgcaaaaattacgtggcaataaactggggacaataatctttacaagtgaatcagatacctgccttccgccacatgcaaccctagagtcaacacgtcacagaccactagacaaatccctcgggcggtgttttcacatttaaaacgacgggacgaggccgtagctgagctcggccgacgtgtacatctgagccacgtcagcatcgacccgcttggcaaagcgccctttgatccgcggcctggtctctgcataagccttccttgaagcatacctgatcgtcttctcgaacttccggttctttcttttctccttatatctcagaaccctagcttcgcggtccagctggacgtactggatgcccacgttcacaacgcctgggtttgccagctcgaacacccctctgttaagaggcctcggcatgtcgcttagcgtggcgtcaggaaccacaccgacatccagcgaggacgaagagacgctgtggctgagggacgtggtagtggtatagctgtaagtgaccttctcggtgtcaaagcaatccgagggtgtcgacaccgcgccgtcctggctgctcacgttgctctgcaccggcacaacgctgtcggtcccgccggtggcctccagcggcgaggcgtagtcgagatccagatagggatccacgtcggggaacaaatctacgacgctgaaatagccccccgctgccttgttaacgggaggacccgcgtcgacgccgaagcagcttcccccgtcgtcgcagttct

SEQ ID NO: 10382 - DNA, 850 bp, Picea sitchensis
  Predicted polypeptide sequence is orthologous to G1488
ttttttttttttttttccaaacattcggcttacataaataagagaaatatcatacatgaaaaatataaagaaaattagtaaccgggacgtccagagatcgaaacccgaagaatataaaaaggcaattagatggtcagttcgaagattttttcgtgataatcaacctgcataacagttttaaagaatgagaaatacgttatgcagaacatcacatgttaccgcataggtttctcagaaacaaaaattcaaaacctaaatttatacagagtacagttgagaatggtcagacacaaaggaatggaattgtgcccaccatgatgtcgagtcttcagtaataattaaaggtaaaatactgcattaaatggtgtgctagctgtagtatgtcatcgaattatctgtcaggcttgaagtttcctgctgtgagagcggctgttgttggtctatcctctgccgcctgatttcgactactcttctgtggcaattcgaatggagcccgctggagaaagtggggctcaacgcgggtctgtactcgggcaggagcctgccggatttgaacctcacaccgcaagcgttgcaaagcgtcttggggcccagcgggcctgttctccactgcggggttttctgtactaaacaatggctgcacctccggctctcctgcccgccgccgcttctactttggcagcccttcttcgccttcttgaccgcggccggtggcgccacgcaaaccgaccccttcatcgccgccttgcgtccggttcggggctcgtcgttcttgagagcaacgctcacgaaaacggcagggttgacgcagcgtgacctcttactccgggcacgccccagcacccacgtc

SEQ ID NO: 10383 - DNA, 770 bp, Picea sitchensis
  Predicted polypeptide sequence is orthologous to G154, G1797
ttttttttttttttttgaaataaaaatataatatttattttcaaatattaaaaattttcaatatcaaatttcaaccttgatccaagttgtgttgatacttggtttcaaaaatacttagaaagacactgcagttgtaatgtctgtataatgaaaaaatgagaagcttgcagtcgtactgtctgtatagtgaaaatatgagaagcttacatatgcattagtaacaattttattatatgagctatcgataggaaggggatcttatacatttggaggtctcataaccagttgagtctccacttcaatgcgctggatgtttccaagctggagtacaggtgatgtcaaaaccggaccatccacatattcagcacacttccttttaagctgttctatttcatccaccaatactttagtctttcgtgctcgtatgtggttcaaccctcgttcagcttggctttctagctgatttaattctttcactgaacatgatgttagatcttcccccatcatctttctttgtgttgattcgaggatcctaattctctcttccatatttgcaatttctcgttttaaatgctgattatcttgctctttggtagtgttatctatgtcactttcttgtgcatacttttgatacctctccaacattttttgcatactgggactggcgaattcatagagcttccctcgtggggcgaaaacaataagtgccacttcagcatcgcagagcaccgacagctcgtaagctttcttcagcagaccgttcctgcgct

SEQ ID NO: 10384 - DNA, 772 bp, Picea sitchensis
  Predicted polypeptide sequence is orthologous to G154, G1797
ttttttttttttttttggatttcaaaataacatcaacaaacatagttaagtatcacaatgacgactatttacatgaaggtgatcttgtgcaaactggaatttcaaaataacatcaacaaacatagttaagtatcacaatgacgactatttacatgaaggtgatcttgtgcaaactggaggtcttatatccaattgagtctcgacttcgacttcaaagtattgtacacttccaaatccaattgcattcattgctaaaacctgtttacgaaggaatgtgttctcctcaagtaagagacattcctttcttttaagttcttctacttgacccaataatatttcagtctttcgtgctcggatatgtctcaatccccgttcaatttggacctccaattgatttaattccttcattgaacatgtgcgcagatcctcccctgacatctttctttgtgttaattcaagaatcctaattttttcttccatatttgtaattttccggtttaaacccttgttatcttgctcattggttgtattatgtgtactatggtgcctctccaccattttctgcatgctgggactcgcgaattcatggagcttcccactcgaggagaaaatcataagtccaacttccgcatcgcagagcaccgagagctcgtaagctttcttcagcaacccattcctgcgcttagaaaacgtaacctgcctcctgctggcattctcgatcctcttcatctgtgtctttcccctcaccattcttggctctcctctgtgtttt

SEQ ID NO: 10385 - DNA, 847 bp, Picea sitchensis
  Predicted polypeptide sequence is orthologous to G154, G1797
ttttttttttttttttggatatgatataataatatagaaaagttcataataaactaagaacatgcttgaatttcaaaataatatcaattaacttagttaagtactcaatcagaattattcatgaaaatgtaatcttgtataaattggaaatgttatacccaattaactttaacttagttatgtactcaatcataattattcatgaaaatgtaatcttgtataaattggaaatgttatacccaattcagtgtctacttcaattttctggacacttccaaatccaatttcagccattgttaaaacctttctctcaagctggtctacttcagccattaatatttcagtctttcgtgctcgtatatggctcaatccctgttcaaactggatgtctaactgatctaattcctccatcgaacatgtttctagatcctcccccaacatctttctgtgagttgatttgagaatcctaattctagcttccatatttgcaatttcacggtttaagtactccgtatcttgctccttatttatactattttcacgtgaaccctctcggtacttctccagcattttctccatgctgggattggcgaattcatggagctttcctcctggggagaaaatcatgaggccaacttctgcatcgcagagcaccgagagctcgtaagctttcttgagcaatccattattgcgcttagaaaatgtaacctgcctgcgggcggcgttctcgatcctcgtcatctggatctttcccctcgccattcgtatctctcctcttatttttccctccaagcaatcactaacagactctcaggtcgggcataacagaactgctcggggggggggg

SEQ ID NO: 10386 - DNA, 679 bp, Picea sitchensis
  Predicted polypeptide sequence is orthologous to G1638
ttttttttttttttttttaacaaaatctaacacagatttttctatcacatctgtaagtactataattcttaaagagaacagaacttatcaaactcacagtctccaagagcagagcagtaaactaaagctttttccagcaatgcaaatatttcatgctgtaacaatacatataagtctctaataaatggaagtgatattactgatcagaacaaagattctcttcaaacttcctttggagtagagaagaaaaatacctgtgctcttcttcagtccagggaacacctttctttctctcctgttcagatggcttggttgatgatcccctcccaccactcccaaattgttgcttcagaccatgcatgtcgcctgattttccttctatccattcaagtgtacaggaagagttactgtaagtgggtagggcaacacagccagcttcaatacaagtaacatcatccacgagatcttcataatgctttctaacatccgtagcagtttttccaggaagcctggccgccactttatcccatctatctggggtgtctttgtcaaagtcagctagagtattttcaaaacgtttgttctgttcaagagtccaaactgaaccagatgaactcaaacttgtcccttgggagggtaaatccatctcccacatcgcacaaatcttaaaatcccttct

SEQ ID NO: 10387 - DNA, 792 bp, Picea sitchensis
  Predicted polypeptide sequence is orthologous to G1646, G715
ttttttttttttttttcttggaaaactagctgataataatattaaaccctttgattccaaaggggcgatatatttacagctcagaattgaaacccatatagaaaatagtagaattgcatagtaatcttgaaactattggaggacaaccaagcttacaatcgaaatgccatttctgatcaaaagccaaataaaaaagaaaaagaaaaagaaagaaaaaaacacacgcagcatgccctcaaaccctgacaaatttagaagttagctcaacttccagggttaggcgacttggattggtctgcctgcatgtgtccccattgccatatattaggcatgtaggccacgggagactgcggctgctgcatataaatagtgggatccatgggttttccaacaaacacaccatgaggcacagaatgctggttgggtaaataatagtaaggaaaagaattagcaccagcagcagcgttagtactgctgcttccaactgagagagcagatctagggtttccaagattaataacctgatcctccttcaactcatcccggggaacgatatcgatcagaaaatcgaatatatcagtcctggctatggccgcggctatatcgttcttctgcagggtccgtctcttgttttcttcagtgtgaatccaggccctgagcgtaagttcattgatgaacatctcgcaagccttggcaaaaactactggagcctccgcagatatcatcctgacattctcgtcgtctgacttcattatcttcttgattctcgccagagggagactgtgattttct

SEQ ID NO: 10388 - DNA, 795 bp, Picea sitchensis
  Predicted polypeptide sequence is orthologous to G1646, G715
ttttttttttttttttgaaaaaattatatcaacgtagtaacaaaataggaaatccaaaaataagtacatgcatctttccgaaaacaagagatacaaaacaaaattaaggttaagctctagcccctagtgttaaaaaggaaacatcaacccgtgggtgaaaatacacttgtcttctcagttggcagaacgaggaggggttccataagaatgctcatctgtcatctgatgttgcccataagactggccatccggcaagtgctgctgctgctgatgtggatgtccataactttgtccgtcgggcatttgttgttggtgtgggtgaggatgatgagggtgctgccacatgggctggtgaggatgaggaggcataccatagggacggggtggctgctgctgctgcatatacatggcggatgggtccatctgaagtggagcaggtctgcccatcattatggaagaggggcccatcattccctgttgatgtggcgattggggcatggaaggaggagggtaatagaatgaaccctcgggggtcacgccacctctggcaaaccctaaacccaaaccctcctccttgaggtcgtccctgggcacaatgtccaccaggaaatcgaatatgtcagttctggtaatggcagcggcaatgtcgttcttctgcaacgttctccgtttgttttcctcggcgtgaatccatgaacgcatggtgagctccagaatgaacatctcgcaggccttcgcgaacagaacgggggcctccgccgatatcatgcggacatcctcgtcggccttcatgat

SEQ ID NO: 10389 - DNA, 854 bp, Picea sitchensis
  Predicted polypeptide sequence is orthologous to G1646, G715
ttttttttttttttttagaaccaactttagcagataactaaaattaactttatcttattcatgttcaaaccctttaaagaagtaacttgtttaaattccattcttgattgtattttctgtgctttatagccaaaccctcgtcttcatcctttcaaaccaagcataaatccatctggtggccatgaaaagatttttaataaacacttattttgtcaaaatatagctagggataacgagaccagagtattgatcagccttagtatctgataatatataagagaccaaccaataaagtatatcccccaagctgtatctcataatcaaatgctgtttttgagaaaatatggctgttctgaggatgctatctaggctcgagagcaatcagcctgatcattcttgattgatactctggcttccacccaaccttatgatcattgctgtggaggttggtacatcaactgctggtctggcattaaaggctgctgagacattaattgctgagacattgtttgttgagcagtcatcacatcaggattaagattgtggtggtaaggctgagcatgcatgagtggaaagtgtatccctccataagacatagattctgcatgaggaatcccaggccagtgtcccccatattcctcatccttgacttcatctctaggaacaatatcaagaagaaaatcaagaacatcacccctgcttatagctcctgcaatgtcatttctctgcaaagtacgtcttttgttctcttcagtatgtaaccatgaacgtaatgtaagctccaaaatgaaaagctcgcatgcctttgaaaataggacaggggcttcagcacttatcatcttaacatcttcatc

SEQ ID NO: 10390 - DNA, 830 bp, Picea sitchensis
  Predicted polypeptide sequence is orthologous to G1646, G715
ttttttttttttttttttcttttttttttttttttttttttttttaaagaagtaacttgtttaaattccattcttgattgtattttctgtgctttatagccaaaccctcgtcttcatcctttcaaaccaagcataaatccatctggtggccatgaaaagatttttaataaacacttattttgtcaaaatatagctagggataacgagaccagagtattgatcagccttagtatctgataatatataaaaaaccaaccaataaagtatatcccccaagctgtatctcataatcaaatgctgtttttgaaaaaatatggctgttctgaggatgctatctaggctcgagagcaatcagcctgatcattcttgattgatactctggcttccacccaaccttatgatcattgctgtggaggttggtacatcaactgctggtctggcattaaaggctgctgaaacattaattgctgaaacattgtttgttgagcagtcatcacatcaggattaaaattgtggtggtaaggctgagcatgcatgagtggaaagtgtatccctccataaaacataaattctgcatgaggaatcccaggccagtgtcccccatattcctcatccttgacttcatctctaggaacaatatcaagaaaaaaatcaagaacatcacccctgcttatagctcctgcaatgtcatttctctgcaaagtacgtcttttgttctcttcagtatgtaaccatgaacgtaatgtaagctccaaaatgaaaagctcgcatgcctttgagaataggacaggggcttcagcacttatcatcttaacatcttcatcagattc

SEQ ID NO: 10391 - DNA, 164 bp, Picea sitchensis
  Predicted polypeptide sequence is orthologous to G1804
ttttttttttttttttcgtgttctcttcttttagttgatttacttcagcttccagctctaccgtataagcctgttttcgagcccgagacctagcagctgactctctgttttttatcattcgcctcggacgcctttctacaactttctcaaccggtccatccaag

SEQ ID NO: 10392 - DNA, 704 bp, Picea sitchensis
  Predicted polypeptide sequence is orthologous to G1809
ttttttttttttttttaataatactaaccgtccagcttaaacttagtgtacattacagattataatgtatgtacattattattctcattacagcccaaaagcaagctgatagttctagcatacatttttgaaagacacatgaaataatccagctttactgatcatcttcaagtgacataattcaatatggaggctcatatagtcagaggcagtgaggttcaaacacataattagaagtgtaccagcacgtcctaatactagtctttgttcttgatctctaaaaccagagaataatatctctggaactggtacacaattgtttattcatattgtactagtaatactctaactaaaacttcgttatctatgttgagtgtgaagttctctcgtgtgtgaaacactgcccaagaaaatgtaactgatgacagaaaggagagagcacacattctgaagggtgctaacaaatctataataaaagcaccttaagattactattcatattcagtatcctactacaatttaggtttctgcgcctgagttaccagatcctgctacaatttaggtttctgctcctgagttaccagatcccttttttttcattgttgtattcttcaaaatctgtctaagcatctgattttcattctgcaaagtggaaagcctttcccctaaactccgagtttttgtgctcaatttctttaacccct

SEQ ID NO: 10393 - DNA, 587 bp, Picea sitchensis
  Predicted polypeptide sequence is orthologous to G1839
ttttttttttttttttttcttaataaagagcataaagagcacagcaagtagcagtgctgattattaatttcaataccataattaacctggaagaatgaagaggaaccaagtgaaataaccagtatctacaaggggtttgtccttcaaaattaaaagcctcaagacctttccagggcccaggctgttgttggattctcattcccaggagaagagtctatcagcgattcatcagaaacaagaggtaacccaagttaggttaagccatagcaagctatttggcccacacagaatccccatgtgagaaattagacatagtctgaggaaacaaacctcgttttatcgagcacacaaccactgtaatccaccatccatatcaattgcgagattcgtcccgggctgaccaaagttctgcagcagctttatgactaatacatttacgcaatcccttaatgttaatggccattgaggcagaaaccaataaaccctagctttcatctatcctcggctccaggatgaatccccttgctcgatgggaattttttctgccctcatctggactctgcggaacgaccatcttgcctttgctt

SEQ ID NO: 10394 - DNA, 651 bp, Picea sitchensis
  Predicted polypeptide sequence is orthologous to G1863
ttttttttttttttttttgagatatcggaggttgtttgattatttacaccgggtgtgagaaagcagtcgaacgagaaacaataaaaccgccaatacccataacgtcaacgcgctcaacacgagactctgatttttgtttaaacgcttgatgtaagactagggagccctggagaagaaagaacaatctgaaaaagtactccagctaaggcgaaaaccaactttttttgtttccttttgtcgtaacattcatgccatgtcgttggccgatcgttcaatcttggagtatccatccgaggattcttccaagggagcaaaaaaccaagtctccaggttccgggaagcattcgcaaagtaaggctccacatactccgcccaaagatgcgatacaccgagtaaaagacaaacaaaaaaaggaagaatgcaagcgataacgaagttgtttggcattggtagcgtctcgatggtgtagggattgccgtcctcgccaatcaactcttccttgaccggagtcattgttccgaatagcatccaagccaacacagtccgtatgagggccccgtggagaaggtaaagcgggaggctcagattccccagccaaccaagtgtagggtgagacaggattctcgagagaattggtgagaatagtatacc

SEQ ID NO: 10395 - DNA, 777 bp, Picea sitchensis
  Predicted polypeptide sequence is orthologous to G194
ttttttttttttttttcgtaaaatagtctcgagttttcactcgcacgctatcaggttattgaaaaaaaggttggtcggtcctaccattagagtgttcatgtctacaacgccactcattagggttttacacaaaccttccagtctttcaaaacatttcaaatcgcattacttacgaaacaacttcaaactttatcatgacctgatttaaaactaagccaaggatgaattgccataggaaataccagatcggttaggttaggtcaatctcttggccaaacctaattaaaaagcactgttaatctgtgacatcagaacatgccacaaagtaacggactctaccatctggctgcttccactagaagaatctcaaatgcaaggcagctccgagtttgggcaaattgcaacccattcaaaaacaaaccatcatgggttacctgttttactgataatggcctctgaaccataaaattgcaaagactttttaaaatctatttcattttatgatcttcgcactctgattgagacctatatctttaaagtccatatgacacggagaaccaagcacctgagaatctgaccactaacttgtaattttcgtacttcattggatcacaacaactcgttgttgtgatccaccagataagatgctcccactttttgcactgctgccttcctcacctccacttgaaagtgggtgaaaagctgatatatggaaatgttgatgttgatagtggttaagatatgttccattagtatgagcatattggtaagttgtac

SEQ ID NO: 10396 - DNA, 848 bp, Picea sitchensis
  Predicted polypeptide sequence is orthologous to G1950
ttttttttttttttttgggaaaaatcgtctcatacagtttcgtaaatccttaaaaaataagaatcaaaagacagatcttaagaattccagcgaggccttttaaataatgccgaatttctatgcatggaaaaagtaattcactcagaaattatgccgaaactagaggaatatataatcgattgtgtacaaaagaatttacctgagcaagattacatagggtcttaaatgtattgaaagacgtaacaaagtattataacatcaaagtctttagctgctctctataagcacctcttctcaactgttagctcaaaatgcctcattattgttgtaacatcccatctttgaggcctgatggcatgttttagctaaaaagcataaatactatcagtcatcaagcatgactttggcagcatcaattagtgttctcctaaaatcccctgaagctcgaccaaggactgtataaccttcattgtcttcacaatcgacatctgcaccatgccttactaaaagtaaagcaatctgcttgtcattgctgattactgcattcataagaggtgtttgacctgttttgtcagtggcatcaacatctgcaccttcctctatcaacagttcacatatttctgggtgccctgcacttgctgcccgatgcaatggagtgcaaccaaacttgtcctttttcctgatgttggcaccattggagattaaatcttgggcaatcttaacccgccctttactggcagcataatgcaaggctgtacgcccaccattgttttgcacagaaacatctgcacctgcttgcaataatgcttccacaacgttagcatgcccactgctcacagcagaatgga

SEQ ID NO: 10397 - DNA, 545 bp, Picea sitchensis
  Predicted polypeptide sequence is orthologous to G2057
ttttttttttttttttttgttgcataactctttgttcattctaagcagcgtacatcgaggttccaccctaagctcagcccatttatcgcgatacctccagatgatcgactccagtacaccaacttactccatataccaagccttctcttccgtcctctatgatttctctgcccaccaatccataactggccaaacagcaacgggccagaacatcaccacagcagtgactggaacaaacatcatcatagtccctccaaaacgtttcagcggggagtcccaagtgggagatgctgcgctcttcccggtgacagtggagtacgtccttcctctgatctgttgcatggcgccattttggagtcttgtacgtgcaagcgcagtgaggattcgtgattgaggggccatttccggtggtgttggagtttgagatgaagtgcggggtaaaggggagagagatagtattcgagtacgaggggattatatgcggaggctgtgggattactgcttgcagttgctggttatagcgaggctcaaggaatgggatttga

SEQ ID NO: 10398 - DNA, 744 bp, Picea sitchensis
  Predicted polypeptide sequence is orthologous to G2057
ttttttttttttttttttttaaccatcaatataggtatattatattgatgatggtattccatacaagcaaaatgaatgtatcaaaacataaatcccatacaagttatactctcaaagttgctgaaacaaatatataaaattcaaagtttctattgaaactttttctattcttaaattctaatctattctgcctcctctccccaggttgtctttgccactggatcaaacaaaaatttctctgctctgctcctgcctttctcagtcccaaaatcagcggattcaagctggatgaaacgaaacagggaggagcgaacaaacctggtaaaaaagctgaagtagtgtgattaaaaacaaaaattcaaaaaagccggggagggcttcacatcggcgttctcgtcaatgccctgaattcgtgccggaatccggaagcccgaaaagccgtcaccagtctgaggacattggccggcggcggcattatcgtgcagcaacggagggttaaatcggacacaaacaggacttgaactggactgaagggttcccctgagtgttaatgagttatagtggcctcctcctcctctcatcatattaggcgccgatacagcaatattattagtgttattgctcccaaaatctgtatatatgctgttgcagttccacaccgggggggcacttgatattctgtgaggctgaggctggctacttaaaaactcatgatgaagctgctcctgcataacaatctctccc

SEQ ID NO: 10399 - DNA, 438 bp, Picea sitchensis
  Predicted polypeptide sequence is orthologous to G2057
ttttttttttttttttttcttttttttttttttttttaattaataataacattttatttgttaaacattgttataagttacgaaggaggttgtgtatgtatgtaatatgtgtaagaagaatattaaagatcagaaacttcacgtgaaagacgaaagccttgtttttcaagatcttgttgagtgagtctgactcctgctctccatttctttgttgtgcttcgtgtagtaggtggaggatgaggatgaggatgagaatgtaataatgatccttgagattgttgtgttgttgttgaagttattgttttatatcgttgttggtcattaatattattagaagaagaatttatttcaacaactcttgcacttcgttttgttggtcgccttttaccccctaatttatataacatatccaactttgaataatcatgtggattaaac

SEQ ID NO: 10400 - DNA, 550 bp, Picea sitchensis
  Predicted polypeptide sequence is orthologous to G2109
ggtccgatgttttattgatatccgaatccctcgccctcttactcgatgaattacgcggggagggttggagttattccttcctgtccgtttgtttcaccatttgttcgatgccggtgagatctccagcacgatttactgtctttgaagagctggggacgagatgggtaggatgaagctcgcaatcagaagactggaacacaacaacaacaggcagattactttctccaagcgaaggaatggcattatcaagaaggccaaggaactggcaatactttgcgacatagacattttgctcatgatgttttcaccctctggaaagcccacagtctgtgtcggagaaaagagcgtaatggaagatgtaattgcaaagttttgtgagttgactccacaagagaggtgtaaaaggaaactcgaaagccttgaagtactaaagaaaacatttaagaggttggaccatgatgtcaacatcgacgattttttaggagaaagatgtagcccagaaaaaacttagagaagctagaggttcaggagcttcataatgagttgacaa

SEQ ID NO: 10401 - DNA, 924 bp, Picea sitchensis
  Predicted polypeptide sequence is orthologous to G2141
ttttttttttttttttatagtcaaaagtattgatgacttagcaccatttccaaattagagaaaaaactgcggttccatctagaagggaggccccgaatctatttgtagatgggatgaaaactgcaaagaatttgagagactcagataaccgggaattcatgacatatatacactcctggtaggtaggttaagtagtagcatgtatgttactatgtatgctgcaactgcaaccaaacattgataaaagtaacacagtcaaactgtgataagtttttgcagtggaggagatcagtgtcagtgtattgagtattagagtggtcgctgctggtgctgatgctgctgcagtctgctttgcagcaaccccatgttatacatattctgcagctcgctgtcccaaccttcctgcctctgaaaatttgtaccatcaaacatttctgcagagtctactgaactcatagtggaaggtatatccgatccgggacttggtactgtctgcagagaagcctgcttcagctggtccaagtggaagtatgttggagacattcccttgcttgagaagcttccagacatctctttggcaaagaaattgtcgatgttaaagtcaagctttggattgactgtagccaatttcatggacaagaactctacttggtgttgaagagattgaacatagttgatgatctcgtcaagcattactgctttaccagtgaccttgttgcaggtaggtaccaggtcctgcaagaatttcattctttgattgatcttttctcttctcaccctttcagctaagctatggctgtcagtagcctggcctctccgtgccctaacatgaatataattatcgtccttctgagagacatttgaattcttctccttccccttctttgagttggagtccgaggtctcgtcattattgtcatcgtc

SEQ ID NO: 10402 - DNA, 378 bp, Picea sitchensis
  Predicted polypeptide sequence is orthologous to G2157
ttttttttttttttttttcgatccgctgttctcgctgttctcgtcttcagatgtatgaaagtcactggttagcatcccgtgggcgtggccattccccggaccgggaacaggagcatacacatctccgaggcctgagcgggtccccggaacgactcccgccatcgccacattgcccgcccaccaccgggttgccaggactgcgtcgttagattccctacaccaaaatctctctaaccttcgtcgaccttgacataaaatttcaaactccctgccttctatcacgcctcgctagctctagctcttctccgactctgatcgatcaacccaatccaatcggccgcgggttcgattctgacagagcataaagccggttcagag

SEQ ID NO: 10403 - DNA, 812 bp, Picea sitchensis
  Predicted polypeptide sequence is orthologous to G2226
ggtgttcatttttctcacttctctctttgttcatgcagatctggttggttgtgccttgtgtcacagaaaatcctaatgggtctctcaagctttcccaccactgtctccgaaggagtcctgccaattctgattgtgaatactgctctgtcttttgccattatcaaggacatcctgaggtcttttcttcagattgtaggccttaccacaggcactgaacctgattttatcgacccatcatggccttacccacctgaaaatacccctgcagtcagtactggccattccgaagcgcagttcattgcagaggaaatcaggcagagcctacccatcaaaaggttccaatcttttactgatgggtttgttggtagtgacaatagccatgttgagtgtgcagtctgtttatccaaatttgaggaaggggttgagatcagacagctgacttgctgccacctttttcacagaccttgccttgataaatggctggaccatcagcagatcacctgtcccttgtgtagatcatgtctgatatccgaagaagcagccaagaatatcaggctcagggaacaggagcttacagatgaatcggtattttggtgttcatccttccaagaagctgcttatcatcatacatggattgaaagttagagttgcttggatcctgctttgatggatccttcaacacttcatccagttatctgggtctataattggagattctgtaatcttttattgtaaatcatctttaggaaaagtgcttatttctacaggatgctttgttgcttctcctattgaaagcaatcctgttttctgaa

SEQ ID NO: 10404 - DNA, 903 bp, Picea sitchensis
  misc_feature (819)..(819): n is a, c, g, or t
  Predicted polypeptide sequence is orthologous to G2239
tccccgaccgtctgagagtttcaattttgtcaggattggctattgcccgggatagggatgaagagcagacgattagcgccgctgaatagttcgaatgatggaggttctgatttgttcctcacaggaaactctgggaatctgagtttctcctcgccattttctgccatgggtttgagcgataacagaacgggggttaacatcagcagcccatccaataacaaccatgatctcttcggcttcaatggtcattttaatccatccttggcgattatcatcatcgtgctgctgagcgcgcttttcatggtggggtttttctcgatctacttccgccgacgcacagacgaagacgacagcatgaggcgttccagacgaaggccgaggggagtcattccacagggatggtgggaagacgacagtaccggtggtctcgacagagacgtcatcgaaagcttcccggtgttcagctacgatctcgtgaagggccttaaggcgcagaccaaagaaaccctcgagtgccccgtctgtctcagccaattcgaggacgacgagctgctccgcttgctgcccaagtgcagccacgccttccatccggattgcatcgatacgtggctcttctctcacacaacttgcccgatctgccgaatcattctggtgcctacggacgatgagaacccaacgggcaccggctacggaattatcgaacccctcgaggttaccccgccggatgaggtaacggttgtggtagacggaacaagaagcagctggagaaacgggagcgttcgcagggacaacgatatcgacaccaccgttgcttccgangaagccgattctcacgaattgcccggcgatcaggcgacagaattcagtcgctcgcactcgacggggcattccctggtgaggctg

SEQ ID NO: 10405 - DNA, 881 bp, Picea sitchensis
  Predicted polypeptide sequence is orthologous to G2239
tgcgctgtctgtctcaacgaattcgaggacgacgagcagctccgcttgctgcccaagtgcagccacgcttttcatccggaatgcatcgatatgtggctcttctcgcacacaacgtgccccgtctgccgaaccagtctggtgcccacggacgatgcgaaccccacgggcaccgactacggaatcatcgagccccccgagatcacgccaccggacgagataacggttgtggtggacggaacgaggggcagcagcaggagaaacgggagcctgcgcagggacaacgctgtcgagagtcccgcggcttccgagatggccgattctcaagaaccgctccgcgtgatggggcttaatcaggcaaagaaattccgtcgctcgcattcaacggggcattcgctggtgaggctgcccaaggacttagatcaatcggccacggaatggtatattagcacggcagaagggctcaccccgggtctgcacaggaactgtagcctgaccgcgcgccctcactcgcgctctcagagatcgttggcctctaaatcccgccccgctctcgcaaagcaggattccttgagaggcgccgcctctttcagcgaagacgccgggacaagttcgggtactggatcagggctccgttggtatgagcgtggactgagatcagagcgattatccctatcatccatgaatccttcctcgtttctaaggacacattcggagcacagggcgccttcctattccaggtatcaagattcctctgcaggttctcaacaggagcagaaggcatatttgcaatctctgaagagcacactgaagaggctcactggaagagacagagagtggacagataattcgctgagcgggcgaagatcttccaggagggctgc

SEQ ID NO: 10406 - DNA, 776 bp, Picea sitchensis
  Predicted polypeptide sequence is orthologous to G227, G242
ttttttttttttttttaccataaagaaaactttttattcatttttgtatacaagccgcagcagaagagaaagtattcagattcacaatatacaattcaaaagaaaatcgacagaaatcgagaacgctttcatcactttacagttctggcccttcgggagacacccattctcccaataaattccaatccaagtgcccctttatttcagacgctttgaaattatccctcgaggccgcaccatgtttctcgaatttctccatttcactgccacaagatccttttttatttcttcagcattaagccaacttctctaaacactggagctacagaattcaagccaggcccctgattcgaacactgcgatccgttggtataattctggacctccttcgcgatcatctcccgcataatagacagcagacttcccccaaaattagaataatcgcccgaacatcctccgtgggaattaccgctagacagctggaaaattagcggcagtgcttgcccgatcgcaattttgacggcagtagacatcatagccatggcttcctctgtcttcaagtagccactaacaggaaacggatccgcaaacgaataaccagtttgctgttgataagcttgaaactttgcagatttcgtctcgaagctttgttctatggggctacattctccactgctgttattctcactgaaagaaccgcttccaggcagcgacaggctcaaggaggtcgggggatcgaaagcgccagctgacccggaagcagaaacagaggcaga

SEQ ID NO: 10407 - DNA, 258 bp, Picea sitchensis
  Predicted polypeptide sequence is orthologous to G2343
ttttttttttttttttttagaaatccagaaaacggcaccttctattcaataaattgtctttctagcgcaaataaaacaaccttcaacaagaataaggatggtaatctctaaataaaagaaacaaactaacatatagtataggatgtgctcagacgtagggtgaatattgaattcctgggcacaaaagggcctcagagtgagctgggatcaccaatcatcattgcaaccatcaattggagatatcacggccagttaatc

SEQ ID NO: 10408 - DNA, 848 bp, Picea sitchensis
  Predicted polypeptide sequence is orthologous to G2344, G929
ttttttttttttttttgagataaatagatttaatttcagatgtatgccgaaccctgccctttccttgaaaaatatcttgtcaaggaagttgcatgccaggatattgcatgcttcagaccaacctttctttggtgaacatcttataaaacaaaatcataaactatatgcatagatattttttacaaaagtcaataaacttacttttttgtttgtccataaacttggagattgaacaggacatacatgttgatgcccccatctgaaatgatgtcattaggttgctactgctgtatggtggcctccactggaaaccatgcctccaacttggccactttctgcattgctgactgaaagaggatgaaatgcagatgaatgaaatcctcgcctttgatgataagtgtaatgcaatccatttgacacactttcacccactccaacttgaccaggagagactgttccagaatgaggagcactgatgccattgccaatttgtgctaaattacctatgcgttgaatcccgttcacttcatgtgaggtaccatctttccctgaatcaggatttagcaccttattactttgacccatagaatcatgagaatcattatcccccgacacatctttctcgttgcttccatcatttttggtgttaagaaaccgaccaccacaaccccttgctcgtcttaaagcatggcggtgtcgagattcatgaagatatggctttctagactttatcagcttgttctcagactctgcttttgcccgagattgtcgtcgtcgcaaaattccacgatattgttttgcatttacatacactggaggttcctcgaccatgtctgatggtggtaacg

SEQ ID NO: 10409 - DNA, 844 bp, Picea sitchensis
  Predicted polypeptide sequence is orthologous to G2425
ttttttttttttttttattaaaaaaaaatgtatcagtgcacgaccttaataatacttaaactaacatatcttggcatttacaagggttacaaaaatatttctcaagcttaaaatgttattctgtgacgtattcactaaggtcttctttaatatagaacctcgctggaactactttgaagaattttcctgttatattatacacaaattcaccagttttctccataaaaggtcccccaaagaatggagcaaagctttttccattctcgttgagcatccgtactacaacgtcactgacgtcttcgttacccaaaaagatattgtctgcagcaaaaacaagatttcctaaaatttcgaatttagactttatttgaccatcgtctcctgctagatacacctctcccttagcatctttcgtaactttgagtttgaactcaatatgaagacgtattttttcaactttgacttttccaaaaccatcgccacgtacaaagtctcctcccaataagctttttactaaaggactagacgaagtagctttgtaatgtcctttcactgtaatatcacatgtcaagtccatcgatgaaactccgctctcgacatcagttaccatcttatgaattttacaatctttaactcctttagctactccgtcgacaagagtgatatctaataaatcagcaacggacactgacacattcttcagctcaagtggatctatgggaggaatccccaattctttcactcccgtttttcctatgctgcttataactgtttgaagtaattctctctggcactcgttgtctcttacactacattttggtagtgaagacacaaaacttgcgtc

SEQ ID NO: 10410 - DNA, 757 bp, Picea sitchensis
  Predicted polypeptide sequence is orthologous to G2457
ttttttttttttttttggatcatcaaactgatcattaaagcattttatgaaacatggtgcgtaaactcctatggtagaagaacatttatcatacaatacataatgatatctctctgaaaagatagatcgatcaagataacgtagatataactcgtagtgactagttgttgcatacttccgcgttcagaacatcgcccccatcctctgagttagattgcctgcggttgtccagcatcaacccgaagtgaatatgaggataatgtgcccagttcttggcagcggcgctaaaagcttccttgtgagttatttttggattgttggctttgatcctctggatttcgtctctaatgaaacgattatatgcagatggaacgcgctgtttcttctcgggctgtctgtaagacggaatcctcgtttcttcgttgtccggataagcatcattaatggcagtagaagaagatgccggatctctggtgtagtcgtgcggaccagtattcgggccttgctgctgcgcctgttgtggcagcgactgcaacaagggcgccatgtttaccgacaaaaggttagtgcaatgaccgcatcggactgtaacaatcctgtataagctgttgcatggaacgtttaccgcgaggattgtgctacaaaagtcgcagtgaacgtagcagaggtgatcctgcccgacttcgaatccgctcgtcgacatgtctgaatcacgttttcaagcaatctcccttgccttctcgtcgggggggggggg

SEQ ID NO: 10411 - DNA, 687 bp, Picea sitchensis
  Predicted polypeptide sequence is orthologous to G2457
ttttttttttttttttttggcctcaagtgccctgtcaacagagctaagtctttattttaaaggcaaacagtgtttaccaaaaaaattatattttaaacacgtggtatgaataactaattgttctcacattacgcatggagaaaatcagaaagcaattgtactgtgttagttccctactaatacccctgcaagagggcttcagatatcattactataaaatgcctccatatgactcatgtgatccagataaatacccattggctcaatttgaagtaccaacaacaaaaacattatgtcgcatcttgaaaagtacttacaaaaataaactactctatgcacaacatgcctcttttgaattggagtcaagatagcatattgactactctgaaatgtacttttccttttcataattctccttttgctgcttgccaggagcggtgatcttgaagtgttctgaaaatgattgaccagggcacagaggtatccatttgagacaatttgtggaagcagttccctatccaagtgctagatataaaatatggacatcttagacttcatactatgaagttgtctcaatctgtattgaagacattctaacccaatgaatacataattattctccaaatgcaccaaggctattgacaaaacagagaccccacctcaaataaatacagtttcatccttagc

SEQ ID NO: 10412 - DNA, 723 bp, Picea sitchensis
  Predicted polypeptide sequence is orthologous to G2510
ttttttttttttttttttgttgaaggattcgaacaagtcctcttctattagacactcacccagacctttcgtgggtgtaaaaaatggcgacaaattagtagaattcgtttgctccgatagatcactacctgactccgactctatgtctgagctaactggcctaaacaattgatctgaagaggaggcggctgcattctcattacttactggagattcttttgggcttctccttgctcgtttattgccatccatcgaaaatctggagctccttgctcttgcagatgcagaagagaacgcaccagctgcttctgcagcggcagcctgaatgtggcgcggagacgaagaaatgggtcgtggaaggtaatcaatgagttctgggaaattaagcatcgcatgcttcttacctttcaagcagtacgcagcgacgtcgtaagctcgagcagccatctctggcgtaccgaaggagccgagccagattcggtttttcttttttggttctcgaatttcagacacccattttccccaactacgacgacgcacgcctctgtactctggatattgcggcttcaacgtgctctcctgttgcggcgaaggggcagacacatctcgagttcgaatcctcttcgtcccacccttagatgtcgatgcagatttgctgcttgattcagtctctgttgatgaagtgagcatggtctcggcgagaaaagaggcttccttatccat

SEQ ID NO: 10413 - DNA, 597 bp, Picea sitchensis
  Predicted polypeptide sequence is orthologous to G2535
ttttttttttttttttttggtttcactgatgtatcgatattgatatacacttgcatttatgcataatgaaatacataattagatagttcgatgacatattttggaggattttccatgcataacatgtcattggcaacggtatggtcaaatgaaggaagaaatataccagtagcacatactgaatcaacaagagttttagttagggtagtatctcgtaacagattacagaacacccaacagaggaagtaatgttagtctcctgttcggcattataaatagaatggtttacaaaggaatgggatgattaacatcccaagaaccgacttcccccacttaaaagcacacccaattcttgttttgaatcaatatggagtccttgctaatgcaaaactgtaccttgcaatgaaaattgctgcagcaatgaatgtgtctctatccaattttgaattctctaacacttgacatttttatagagatgctaccagagagaacaaaatgtggaatcagcaccaaggaatggagaatggtgacatgtgaattgatgcagcagaagagggatctctgaacatgacttattctcaaatcttggaaattacc

SEQ ID NO: 10414 - DNA, 815 bp, Picea sitchensis
  Predicted polypeptide sequence is orthologous to G255, G664
ttttttttttttttttgagctaaggatagtttatttttaatgacagtttatcaagaatcttgagtctgatgataaacgaaaattcttctacaaacaaagttaaaaaggcgacaaattcgcaactgaattttgatatttcttacaaccatgaataaattattaagagatctggatggattttccttgaattagggcacgagtcctggttcttccatcgcgttattgcgaatctccagtctcatctcagaagtagccttgtcccaagagggcattcttcgtaacgacacagatatcctttttcatcaatgagatcgccttcgcccggtttggattttaaaatgggttcttccttcgcagctgcgtggattgaaggccaagttattgacagctccaggttcagatttaggttcgagggttcatcccgcgctagtgatccgctcgccgcatctgaaacttgctcggagtcgccgcataatcccgacggactatgaaagaaatcttcagcaatctcacgcgaacttgctatttcaggctcgctgacattccctggaagagaaagatcacggcgagaattcctttggaatggacgatgggtcaggggatcgactcccatactgataagctttctcttcagatgagagttccagtagttcttgatctcattgtccgttcgaccaggcaatcgaccggctatcagagaccacttatttccaaggagtgcgtgcagtttgagaataagatcgtcttcgtcctcagaaaaactcccacgtttcagatcagggcgaagataatttatccatctcagcctgcaactc

SEQ ID NO: 10415 - DNA, 833 bp, Picea sitchensis
  Predicted polypeptide sequence is orthologous to G255, G664
ttttttttttttttttagaatttagacatcttatgtttcatatgtaatagtgtaaataaagttcaacgataatacacattaggttagaaaagagaccagctctgatctggaagacggttttcgaagatttagtattttccccgtagggttttatcgatggataagggtcaaaacggtcatttcatctgttatcaaccgtctgttggagacagtggcggagggcactctccatgacgacataaatatccctttccctcactgagactgctttcgccttgctcggaattaacaacggcctccttcccagctgcgtggattgatgggcgagttattgacagctccaggttcaggttgaggttgaagcggggaagctctttccgggctagtccgcttgccgcatctgaaacttgctcggatttggtgcttaattccggcggacaatgaaagaaatctgggacaatttcacgggactgtgctgttccaggctctccaacatttcctgaagccgaaggacgatgacgagaattcttttgaaatggacgatggttcaggggatcgacccccatgctgataagttttctcttcagatacgagttccagtagttctttatctcgttatccgttcgtcctggcaaacggccagctatcagagaccacctatttccaaggagtgcgtgcagtttgagaataagatcgtcctcatcttcagaaaaattcccacgtttcagattaggccgaagataatttatccatctaagcctgcaactttttccacaccgaagcagacctgaggcgttggggagagagcgccagcagccctctccatgagcctg

SEQ ID NO: 10416 - DNA, 813 bp, Picea sitchensis
  Predicted polypeptide sequence is orthologous to G255, G664
ttttttttttttttttgacgtcgcgattttccaaaataacattgtactcaaccgcaaaattgtattaaacctcggtaacaatccatttttacaatcagtcctatgtggcctcgaattaccaccctactaaaagaaatccttaacaagtggattttatttaaccctcacgattccaaatggataactaatattttattttgtacgattccaaatggataactaatattttattttgtacatgcacaataaaaatgggtttgtagcgcttaatgcaacgtctccaaagataattggaccatgcacagaggagggatcaaagaattttttaatggcttccttctggacaaactttcagcgggcgaaatcaaactccttgtcgacgctgatgctggaacttgaactgtacgcttcttcgggcaatttgatatttgaactggagtcctttcggcaaatttggcctctcagtttaactgtgatttgggacgagagattcactgcaagtgtcaaatgcacaaatcaagattgaggtcgggacgctcttcggcgtcggaggcggcccgcttgaaggctgagctctcctggcggtcataatgaaaaaaatctgctacctccgccgttctgggactctgaaacccccgaatttcatgctcagggatgggccgagagctaagagtagtcttgcagggctggccgaggggacgatgggactgggggtcgagtcccctgctcagcaattttttcttcatgtgcgtgttccagtaattctttatctcgttgtccgttcgccctggtaatctccctgcaataagcgac

SEQ ID NO: 10417 - DNA, 541 bp, Picea sitchensis
  Predicted polypeptide sequence is orthologous to G255, G664
ttttttttttttttttttcgaaaaaaaatagaactttgtcttataaaatattaaactcaccataaaacttggaagcctccttattgactcagccactcttatgagaaatggctagcagcatccaccacagtttactcgtagccctatgtcacaacacactccgccaactgaattagaatttgaatccatgattctatccagtgcaccggtaactctgtttaatgcgatggccgaattagatgacaagctgatacacaaatcgagattgaggtcgggatgctcttcgccgttggaagaggccggcacgaccggagagctttccgagcagtcttgttggaagaagtctgctatctccggcgttccagggctctggattgccggagtttggtgctccggggcggctcgagagctgttgtgtggcgagcagagggggcgatgggattggggatcgagtccccttctcagcaatttcttcttgatataggacttccagtagttctttatctcgttgtccgtccgccccggcaatctccttgcaatc

SEQ ID NO: 10418 - DNA, 817 bp, Picea sitchensis
  Predicted polypeptide sequence is orthologous to G261
ttttttttttttttttagagcatcattacacacgccttgtccttggggattctgagaatgactgtgcataggcttgcgtctgtgaatatttttcaacaaattcctttgtccccgaagaaaatcttcatttgcgaattcccattgatctggatcaactttcctaaagccatatgtattgagctgtctgacaaagctggagaaattgttgtgcttgaagtacttgggcaacaagtctcgtgcgaattccggggggttccacacaatgaagctgttattcccggggctccatgaaactatcgagtccgtggagttgtcgtccaccatgtcatacgtcttggtgagaaacggaggcaccgcattgccaccgctgttctgagatccatccatatcctaaaaccccagaaatcgaaaaacccaaaagcgaaaaaacccaaatcaatacatggactcagcccgccgcggtacctcaaatttacatcattcggaacccaaacactctgatttctcagaaggtgctggcggagtccttagagcaacatccgccgatccctggtcggcatcgtttatggttgagactaggacggtatctgatcgtcttcgagcccccaactttcgttcttgattaatgaaaacatccttggcaaatgctttcgcagtggttcgtctttcataaatccaagaatttcacctctgacaatgaaatacgaatgcccccgacagtccctattaatcattactccggtcccgaaggccaacacaataggaccagactcctatcacgttattccatgctaatgtattcagagcataagcttgc

SEQ ID NO: 10419 - DNA, 802 bp, Picea sitchensis
  Predicted polypeptide sequence is orthologous to G274
ttttttttttttttttaagtaatcaggccttgcagcatattcacatgaatccatcctcttacattaaagcccaaaatcgcaacaaaaattcagaggcaggctccattgccaatttttttgcaaattcctttgtaagaacctaaactaacttccttgaccatccgtggatggggaccttgctggaatatcatacaatgttccgatcatacttttctcattacttttgctcaaaagtctgcagtccggttcccatcagccacccaatactttttcacagctatcaatactttttcaggaacaagaggtccatcttcatgatccaccagcttactatcccatctaataccacctaacacctttttcaccctgttcaacacgtcaacgttgtctcgaagtataactgcaccctctgggcgcaaaatacgatccatctctaaaagaatgtcttctatgttgcacctgtcttggtacatgttgaagactccgtttgcatgaattaggtcatatgtccttggatatgttgagaaagcttcacaccagtcatgataaattccaataaggcctctttcatatatcacaccaagtgtattgtcttttgcaatggttgggacaacattcataacccaagctttgttggatgtaagtgctgctgcgaagccaccaagacctgcattcatgtccataacattgcgatatctaatctctccaataaatttgttgattcttttgtaggccgtcacgtgcttcttccacaactgtgtatcagcattatatgactcagctgtaacacctgataatgaac

SEQ ID NO: 10420 - DNA, 775 bp, Picea sitchensis
  Predicted polypeptide sequence is orthologous to G2790
tttttttttttttttcaacaaacgcatttgctttttctttagtgtttttggcctcgtcacatcattgtcaatacacagccatacacagaaaagtgcaaaatggcgtcaatagataagggcggaaaagcagtatagcatctttgcaggttgcatctgcttttctcagacagacatatacatattttatatatatcacagagaatcataatctaaatgggacatcgaggacgggactgcttttcgtcccgtcctcatctttctgcttttctactattagctttgaatttatgtggtaaaggtgacaactgttccgttgaaaaacgcaggaacagactgaaaagaaaaaccaaaaagaaaggggttgcaggatgtcaaaacttggaaccgcttccgattccagatgtccagaaatctgccccgttgttgttggctacatggagagtacatgatacaggaaccaggcataatcctctgctccggaggtcgtatttcgcctgatctcctcgcccatccttttgattggagggaatgcctttgagataaggtgagctcaatacctgaacctgatcttgtagaaatttaatgtatcccatggcttcaagaagaacggatgccgtatcggtctttccaaacggcgaaacgagctgctgtaacgctgtaatgcgttcgcctagcttctctttgcgcaccttcatcggagcgcccgcagaaacttctgttctaggtttcttgaaagctgtattggaaagccccgcttgatcgctgtttctctttt

SEQ ID NO: 10421 - DNA, 769 bp, Picea sitchensis
  Predicted polypeptide sequence is orthologous to G2982
ttttttttttttttttctcctttgaaattatctccattgccataagtacattcagtgcatcagaaacccttcgccaaatgttcttttcatcatattgttgccggtctggtgaaacaagagtgctatccagatttgcatattcagctacaagttcatctgcaacctcattatatgtggtccgccccttgctctcaaccttctgactgactttcaagctgaactgccacagtcccctcccacccttctccccaccattgactctaggaactctttttctcttccttgtgcctgcagtctctggagaatctaagtcctcttgatgaatatctaaatgctgtacccttgcaatatgattgtttcaggaaggtgttgcaattgctgcatcactgcctcttgatggagagccagcacttccactttccacacaaattgattgccgtggtgcacatgcagaatttcctgaacatctaccagaagttgcatttgaaggatattctccctcccctaactgtggagtggatttattttcctcaaccttcattccattcgtatttgtcccattttgggtaatgccaaagccttcagtatttgtcccattttgggtaatgccaaagccttcaccatatttttggatgctagcttcacggaactcgctaatgatgtctttccgtaaactgttattgttgtgaggagaagttgaaaacactgattgtgctgctgctcttctgttcctgatgccacttctgggtccagttgccctacgggtgga

SEQ ID NO: 10422 - DNA, 785 bp, Picea sitchensis
  Predicted polypeptide sequence is orthologous to G2989, G2990
ttttttttttttttttgaaaagggtaattagcagcccattaaattactcaaggccaaatggcagaaccacagaccatacaggcacagccgacagaaccctaattgaatacaaaagctgcctagaagagggaataaattactttacacttatgatgacttcgatctctgcagtgaaagatctcaacagaagatacccttctcgtgatgaaggattcaggagtgagatccaaaggaaagagatatttttcaattcataaattcaggaaataaaaaggattaagcagaaaacagctgtcccccaaaaccccgaaagaatgcctgaaatccatagaaattcaataaaactcccatgtcggtaacataattttcaagatttcttaccgagagtatgcttgttgttatgcatccagaccttcaaaacacccttcccgacaccaatttcattacaaaactgctgcacaatagcctcatcctgcttctgcatcctccaccccatcttatctgcgaacatatacatcttctccttctgatcctgcgagaacttggtcctgaacctcttcttcatgcctctatgatgatggtggctgaggttattattactgttgttgttggtattgccatctgggtcatcagactcggtgagaccagagcttagcgccatgagcatatggggagccgaggaaccgtggggcaaggggagggggtaataggggacaacgggggaacccggccctgacgaggatgcgccgccacgcttcttgcggaggcagcactcgcaggtgggg

SEQ ID NO: 10423 - DNA, 432 bp, Picea sitchensis
  Predicted polypeptide sequence is orthologous to G2990
ttttttttttttttttttcttcgtttgtgttatttggctattggagaaggaaggaggagggcttgtggtcatcatcactcattgtggagatagctaaacaaccatcatcatcaccatcaaggggtttttagtggagcaaggtttcaatttcatttgccaatcggtgttgagtcttccattcataagtatgtatttaaatcccaccatgttaatgctatttttttcatagatttatgcatgtttgcttgtctctttgcttgcatacatattgcttcttttttttgtcattttgccatgattttcatgcccataaaacaatgtaagggttttttctaaatgggacagcaagcctgagccttgatattaattttttatccaccctcttattgtcgtttttcattgctaataatataatctagaggtttgattttc

SEQ ID NO: 10424 - DNA, 774 bp, Picea sitchensis
  Predicted polypeptide sequence is orthologous to G3067
ttttttttttttttttcctttgatagcacaactttgtattaatctattagcatttctacaactaattacatatacatcctctgcatattcagcagtcacatttaatcctctattctgtaagagagaatcttcaaactcttgagaacaagaaccagtcacagcattgcagcgagaggctgccagctctatacacccttatcagcttcctaatatctagtcactatgcaaacaagtcataatgcagcacactaaaggtattaatctgcccaaagaattcaaatactctatcaacatccatctcttacaatggaagatttagagtaatgaaagagggcaaacaagaagatcaggctggtggggttgtttacaaaaccacaaacaaatatgacagacaactaaaataagtccaaacacaagatatggaccaatcagtatacgtaaaagttaaaacagtcagcttttttttagatcttatacatcaccacaaaacaaggaagcaccgccttaggattaaacacaaacaactcatccagattagagtagattcctgtctgaccagctaatgaatcatatccaccatttagacactcgtctgggtcttgggacttttaacccgcccagcaataactctgcaaactagcattgctctcttctcctttgattcatcctcctctgatacctcaatggaatcatgggcttttccactgcttgctgttgtgtaaattcctttcccattctcaacttttgaggaaaatccatgtcggataatattgc

SEQ ID NO: 10425 - DNA, 951 bp, Picea sitchensis
  Predicted polypeptide sequence is orthologous to G3067
ttttttttttttttttttgatagcacaactttgtattaatctattagcatttctacaactaattacatatacatcctctgcatattcagcagtcacatttaatcctctattctgtaagagagaatcttcaaactcttgagaacaagaaccagtcacagcattgcagcgagaggctgccagctctatacacccttatcagcttcctaatatctagtcactatgcaaacaagtcataatgcagcacactaaaggtattaatctgcccaaagaattcaaatactctatcaacatccatctcttacaatggaagatttagagtaatgaaagagggcaaacaagaagatcaggctgtggggttgtttacaaaaccacaaacaaatatgacaaacaactaaaataagtccaaacacaagatatggaccaatcagtatacgtaaaagttaaaacagtcagcttttttttagatcttatacatcaccacaaaacaaggaagcaccgccttaggattaaacacaaacaactcatccagattagagtagattcctgtctgaccagctaatgaatcatatccaccatttagacactcgtctgggtcttgggacttgttaacccgcccagcaataactctgcaaactagcattgctctcttctcctttgattcatcctcctctgatacctcaatggaatcatgggcttttccactgcttgctgttgtgtaaattcctttcccattctcaacttttgaggaaaatccatgtcggataatattgcagacgttgcaggatggaaaattacataggttagttaatccatccatgccaagtgaacaagtgaatgtgatggagtggaaacgaagtagttcgttggcatctgctatgcaccttgggtgcttcttggctgacttgttggctttagcctttaccatgtctctgtaatcttcgaatttgttgc

SEQ ID NO: 10426 - DNA, 892 bp, Picea sitchensis
  Predicted polypeptide sequence is orthologous to G4
ttttttttttttttttttttatctacgtacacaagtgataacaccatgaagaaggattttttcagatacgctacaaattgtctccaaaccaattacacagaaggactaccattggactgaaaccttctgcaggggacagtctggcccccatcaagctagtagattagtcattagaggataaaatagcatcttaatcaaaatctccagagattcttcacaattttctctgcaactaaataatccacaggtcccagtacccaaatgtttcaaaaacaattttactacatacgaatcctactatcctgtcttcagccccttgaagaggcttaactaatagaaaaacaaattataaaacataaacagaaagtgcaaaatatgagtccaaaagacctatacataggcctgcaacatcaaaattcaaatcacgagtctgcttgcttgttatgtatttataagaagcaagaactaagactgttttgaaaaactaaacctgaaatgggcagatcgtcatagagccatgattccatggaaccctgcacatctggaaaagagcccacagcatgacccgcatcttctattgattgattcacagttgcattaagattcggatcctctgtcaacccaagatatgactcaaaatcagaaaactcaagttcaacgttgttatcctctgttttgtagaatccacctgtcccaccatcgacctcaataggggtatccacagttccgtctttaacaacatcatctacctggggtttaatgtccacaaaggtagactcatttgcatcatcacatacagacgaaatttctggggttttcgtatcataagcccatgggaaatgcgccccttcaaatgacatgctgctatgatcagaatcaaaataacctactg

SEQ ID NO: 10427 - DNA, 817 bp, Picea sitchensis
  Predicted polypeptide sequence is orthologous to G4
ttgagtggtggtcgaagagccgatagtttcattttgagtagtggttttcagtcgatattttccagaaaagtggcggtttcgaatcctgcggaagcagcaccagctggtttgagagcagcagcagctggtttgaaagcaaaacgatgtgtggaggtgccatcatctcggattttattcccgccaatcgttctcgtcgtttaactgcaagggatatatggccggatttcgacacgttcgctgagtacatcaatggtggagccgtgccggaatccttcagtaaatccggcagcttcgacaagggttctcccgactccaacgagggatacaagcagaagaataagcccagcaagggtttcgtcgagtccaagcaggagttttcttcaggtgggggaaatgaagcgattcctcctttgaaggattttgaagggcccgtagccaagagcgcggggaggaagaggaagaatgtctacagaggtatcaggcagcgtccatgggggaaatgggctgcggagatccgagatccgcgaaagggcgttagggtctggctaggaaccttcaacacggcggaggaggccgccagggcctatgatgcagaggcgaaaaggatccgaggcaagaaagcgaagcttaactttgctgatgattcttgttttgcaaatttgggcagcaacaagaaagtgccagggaagataaacaggaaagtaaaatcctcttcgaaggatgtctgcagatcagatgtgccaatctacggctacgatgatatggaaaatggggacttggagttctcaaaacccggtgccccttttcaaagcaattc

SEQ ID NO: 10428 - DNA, 860 bp, Picea sitchensis
  Predicted polypeptide sequence is orthologous to G409
ttttttttttttttttgtttgtagaacaataacatcaatatatagcagattggtaggaagaaaaaaggtaacaccgctgataaccaccgtaaataagctttgcttatctttatgtcacaaaggataatatatgttctcaagagaaaagctaggccagatgatggatggtaactataatggaatataagataatgcttgttacttgctagaggcctgaagaccaattataatcccacaagagcggaccagtctccaaattattgtaaaacaggtaattgcaaggttcatctgcttgactcacattttcctctactttaggcctgaaattgcattcaagccgagggtcacgagctttcacgttcgagaatcctatagaatcaatattttgttggctgtcaatggtacccgggctgtccatgtccaaaacagaactgccttcacttccaatgctggaaggcccttcattattattttccttgtctgcacaatcaactttggttgcagacatcatgagaagctgcaagtcctgatcgtctttctgtaatttggaagaattcgcctgaaatttctggtcattgcagctctgtgatttactgctcatacgttcgatcatggcctggagattgttattctcttccataaggttatcataatcttgcttcagagcatcatagtcctgcttgagaacattgaagtctttctctagttgcttagttttccatcttgctctcctattctgaaaccaaacagcaatttgtcttggctgcagacctagagccttggccaactgcattttcttctctggttcaagtttgtttgcaatttcgaaatttttctctagagccctcacttgctctaag

SEQ ID NO: 10429 - DNA, 764 bp, Picea sitchensis
  Predicted polypeptide sequence is orthologous to G409
ttttttttttttttttttgtagaacaataacatcaatatatagcagattggtaggaagaaaaaaggtaacaccgctgataaccaccgtaaataagctttgcttatctttatgtcacaaaggataatatatgttctcaagagaaaagctaggccagatgatggatggtaactataatggaatataagataatgcttgttacttgctagaggcctgaagaccaattataatcccacaagagcggaccagtctccaaattattgtaaaacaggtaattgcaaggttcatctgcttgactcacattttcctctactttaggcctgaaattgcattcaagccgagggtcacgagctttcacgttcgagaatcctatagaatcaatattttgttggctgtcaatggtacccgggctgtccatgtccaaaacagaactgccttcacttccaatgctggaaggcccttcattattattttccttgtctgcacaatcaactttggttgcagacatcatgagaagctgcaagtcctgatcgtctttctgtaatttggaagaattcgcctgaaatttctggtcattgcagctctgtgatttactgctcatacgttcgatcatggcctggagattgttattctcttccataaggttatcataatcttgcttcagagcatcatagtcctgcttgagaacattgaagtctttctctagttgcttagttttccatcttgctctcctattctgaaacaaacagcaatttgtcttggctgc

SEQ ID NO: 10430 - DNA, 799 bp, Picea sitchensis
  Predicted polypeptide sequence is orthologous to G450
ttttttttttttttttcccacaatctcatgcaatgttttgataaatgaaaacttacatcaacgcattcttcaaggaggaatccgtaatcttatatacattacaattgaaacaatgtttcgtttccatgacaagcaggtcttgagctagctacagaaatgaatatacccaactgtcatcatgacaaatagcaaaatacacttttacagttcaagggcaacgttgcctttcagaacgttggaatctaacagaagttaacatatgaaatcctgaatccactgtcaataatcctgcactgggatgacgctgggtttcctttattcaatacttgttgagacagtaagccagattagtaaatagaaagatggccaggatggttccgagatcttcaagttcaatggcagatcctttgtgtcctgattacattgccttggtttcatccaagtcaccagtttctgaggttttactagtcaaaacacaagatagaaactttagacgctatgattttcgttagtttacatccaatcctccaatctggtctggcaacgttccatttttaccaatccaaatgcaaagcaacttccaaagaaaagggtcatacgcgaatcctaaatcctgtttttacgtttctccatggccctgggagctaaaccaatagcttctgaaaccttcatgatccgcattcttttgcagaaatcaacaaacatctcccatgggacatcaccaacaagcatccagtctccgtctttgtcttcataggtaggtacatattctgaaccattcagcagatccatcagcttg

SEQ ID NO: 10431 - DNA, 811 bp, Picea sitchensis
  Predicted polypeptide sequence is orthologous to G450
ttttttttttttttttctttcaaagttttgagacaattgcccttgtcaaagtttcaaaataaaatttacaattagcacccgctccactgttgatgaagacatggctcctaagctgtaagcatgctcagatccaactcaatgcagttattatattcctttgtagagagccaggtctgtgcttccaagtcacgtttttagactgtcggaattcagttttcacaaagtttaattaaaacttaaaacaaagcatcatagaaggactctcactgttcctgatggtatcctctcccatagtatactgccttcccaagtacacgagacctgcttctgacctgtgcataatgtctcattgcatatgccatcttccaatcatttccagaaaaaaaaaaattgattctaataacaaaggaccagtgactataatccagccgaagtgaatatggtaattataaccatgaagtgagcaagtctgaatgctgatcagaaacgaattagcctttctgctggccctgtttttgctgcaattgaatgagaaacatactcgacttcagctaactccacatccaccaactcatccccaatccatatgcccacagagtccagagaacaggtcatccttgagctttagctcctacttttacatttttccatggccctgggagcaaggccaattgcgtctgatcccttcattattcgaagtctcttgcaagaatcaacaaacatctcccagggaacatctccaacaagcatccaatcaccgtccttgtcctcgtaagtaagtacatattctgacccatgcagcaggtccatc

SEQ ID NO: 10432 - DNA, 745 bp, Picea sitchensis
  Predicted polypeptide sequence is orthologous to G450
tttttttttttttttcaaaatcaatcatttcaataatcatatatcatttcaataatcaaatacactgaaatttctggatcctccaaactgtatttggttgaccaccatatttctaaactgtatttggctgaccaccatatttgtatactgcacataacttctgaaaaagccagttctataaatccataaattaaattagtcagcattccggagatggaggctcgatttcccccaccgtgggaacttgtacaatgaaaacagtcagtgctcatccgattccatgccggctcatcgtaatttctaacacatgcattagcaagtcaaaaaattatcataaatagtcagcttccacattcactgaacaacaacatcgtgcaaaatttttgagtggactctaatgcctgtttttacaattttccatggcccttggagctgtagcttccgaagccttcatgatccgcattctttggcaggaatcaacgaacatgtgccatgggacatcgcctacaagcatccaatctccatccttgtcttcataaataggcacataatctgacccattcagcacatccgttgaattgctatcgttcaacccaagggatccacacttgcccatggtaattaagcagctgaacatcttctccagttcaaaggagagttcctggtaggtgctgtacattttgaggtccacctttctgagatagggagctccatccatgctcaccttcacatacagagaattggc

SEQ ID NO: 10433 - DNA, 699 bp, Picea sitchensis
  Predicted polypeptide sequence is orthologous to G450
ttttttttttttttttttggaaacagccaaatggttttataaaatatagacacagaattcaatttctgtgatcttgagctatcgtggatgaacatacacgcatattacatgtcaaagaataacaaaagcctgtgcggtattgtctaacaggttacaattagtttgagagcaaatttaaccaaaattctttaaatttgcacagtgaaattcctgtatccatgaacttccatttgattcatcatcggatactgaacagaacttgatgagaaaggcagatttgtaaatccaaaatatttgatgtgtgtttttgtagagagcgtggtcactgttttttacaattaggttgagattagatttgtagagaggctggggcgcgttgtaccccttcgacgaacttcttcgtttggaagagtaaacctgattgatttcgtggctgggcccttcgatcactgagatgaaccaaatctacaatctggttaagctcaggttccaataccatgcctgctgattggacagaccatcgtaatttctgatcaaatatgccggcccttggagctgcaacataccaatctgatcaaatatgtgtggaatctaattcctgttttcatttttttccatggcccttggagctaaaccaatagcttctgaagccttcataatccgcattctttggcacgaatcaacaaacatctgccatgc

SEQ ID NO: 10434 - DNA, 596 bp, Picea sitchensis
  Predicted polypeptide sequence is orthologous to G635
ttttttttttttttttttcaagaaagaaattatattaatgtttacataggccaatagagcaagagccagacaagttgtacaacttcaccctattataacagagatcaccctctttcagtgccttgaagaaaaaattatattcatgttcgcaaatgatcaaattaaacaagttgcacaacttcatcctacgcccattccgacaaggtttaccctgcttcggcagagcggccggggccgacggtggcagtgagctctgcgtaataagggctctcgctccgatccctcttgccatcgctcacatccttgaactctgccatgagcttgtcccacttttctctgcactgtttcccatcccgcttaataccctccgcccccaaaagctcagcaagctcttcccacaacgccgcccgcctagccgacttggcgaatctcgactccatctccgccctgaacttaattaaccgcagaacctccgctcgcttccaattctttgacctcttcttcggccctccaccgccgccgacgacggtaatagcagctgcgccagcgtcgtgatcagtctgttcagaaccccccgtggtcggtttttttttttt

SEQ ID NO: 10435 - DNA, 625 bp, Picea sitchensis
  Predicted polypeptide sequence is orthologous to G653
ttttttttttttttttgatggtcgactcttttattggtgttttttataaaatagtaaatataatagaccgataaacaaaataaattaagcgatagcgataaataaccctaactataataatttaaagaacagattggcgtgcggcagtgagacgccgctgggtggccggggtgtggtggcgactcgctagcgctgctggtgactgctgcgctcaattcgcgtcactcttcagatggtctccgctgtccatggaaagacagcctgcgccaccgccgaagccgtagcctttgggaccgtatttgcggccgtggcagtttttgcagtacagttcactttcgtgttctgcggcattggtggagtccagcatcttctggcacatgccgcatttgaagcacatcttgtgccatttgaatccgccggcgacgcgctcctcagccgcgtacacggacttgccgcacttcgggcacttcgggttatctgctggtttgaaaggcattgtgctcgcttaacttatcctgttcgttgattcgctacgagagtctagctcccgaacgcgtgtacagtgcagggcggtgctgccgagactgcggtgcgcggaggtcgaatgatcgggggggggggggat

SEQ ID NO: 10436 - DNA, 908 bp, Picea sitchensis
  Predicted polypeptide sequence is orthologous to G653
gatctgcagcagaacgggttggaatggagttttagaagcatcagattgattattcgctgaagaaaaggcacggaacttgtctgaatctgctgtggagctgccagatcttgtattctgaggcgaaaactggggcgagaaaggttttcacggctatttagaacgcgagggctcaagaccgttattttacaataaaaattatcggatcgtggctatggccttcaccggaacgcagcagaagtgcaaagcttgtgataaaacggtttattttgtggatcaactgtccgcggatggagtttcttaccacaagtcttgcttcagatgtaaccattgcaaggggacgctcaagctgagtaattactcgtcaatggagggagtgctatattgcaagcctcactttgaccagcttttcagagagagcggcaactttaacaagaactttcagtcccaaagatcaagcaaagtaattgacggactttcacctgaactgacaagatctcctagtaaagtgtccatgatgttctctggaactcaagacaaatgtgctacctgtggaaaaacagcataccctcttgagaaggtcactgtggaaagcttatcctaccacaagtcttgtttcaagtgttctcatggggggtgttcaatcagcccttctaattatgctgcactagaaggcatactgtattgcaagcatcatttttcccagctcttcaaggaaaagggaagttacaatcatctcatcaagaccgctactatgaaacgagcagctgcagtacctgaggtagcaagtgcagtccctgagatataacgttattgtgatctagttacttgattatcatttgtgtttgtattttgaagaagttacacggtatgctagtttgttggggaaaagagacctgatcctctctttg

SEQ ID NO: 10437 - DNA, 349 bp, Picea sitchensis
  Predicted polypeptide sequence is orthologous to G663
ttttttttttttttttttaattcaaaatagaatggtttgcctctttaatgggaagaaatatacatccagtaacaaagttggttcggcctccctttcattgtatcaggtgtcattcaacaaaggaaataatgacaactacgtttgaattttatcactttctcgtgtccattggaaaagtaggcacacaacctcaatttcccatttcaagagaatgctacaatagattatgtaaccttaaaattaagttgattcaagttctctttctaaagtttgaactccggcctttatagcaaaatggagcaattttatttacagctcgatatctgcatcattactagtgcctttcccc

SEQ ID NO: 10438 - DNA, 570 bp, Picea sitchensis
  Predicted polypeptide sequence is orthologous to G732
ttttttttttttttttttcaactcgacctgctatgaggcctcttcaatatccattgcatcacaaaattgtacagatgatctaaagatggatatggtggtggaaggcttactgaacaatatcagatgcaactgaagacttaacagaagcctgaattctggaactccaaattatcaaaattacccaaagattgctgctgctgctgctgctgctgctgttgcatggagatcagaacctgaagcttctgatacaaatcaatggcttgagatctgagaacacgattctgttcctccacctgcaaataatgctgcgaggcgatattgaatttgctgagaatatgattgttttctgccctcagttggactacctgagctcggagctcgtccatgtgctgttgtttcctcattctggacctccttgcagattctctgttggataacattctcttctgctttctctcatcgattacattctttttctgctcctgctgctgctcctgttgctcctcttcagagcccgagtgggaggagctgggaggacaagacccataactcatgctgctggaagatcct

SEQ ID NO: 10439 - DNA, 569 bp, Picea sitchensis
  Predicted polypeptide sequence is orthologous to G843
ttttttttttttttttagaaagacacaaggaaagatatattattaatgaatcaatgagtggctcattcctcaccctgaatccagcccattcttgaaagcaaatcatacactctatccactttgtcatgatcaactttaaaaaaacgatatgcatcagatctttttacagaagagcctttcagactctctaacattaaaagttccttcattttaagataatgggccggtagtaatctattctgggtgcaaagttgtcgttcagtaacagatagcaactccgtgcctggaaaacccattatgtcccattgtattaacgatttctttgttcccttttgccctgtagctgcaggacatgtgttgttgcctacaggtgcctgccctgcggtactctttatcttttggttgtccaccataccccctggactaccatctccttctcctctttctctgtttgtagtgcggtttgcacgctgagctacttttgcacttgcagccatttgataactttcctttgattttttctgattggcttcagcctctctcttctttttctctgctgcgtattgttc

SEQ ID NO: 10440 - DNA, 811 bp, Picea sitchensis
  Predicted polypeptide sequence is orthologous to G896
ttttttttttttttttcccataattcttaaatcctctatcacaaataaaccaaataaaatggtttttcctcatattaaaaatcctccatcgcaaataaaatggcttctcaatcacaaataaaatggcttctcattgatatcaaatggataagaagatgacaattgtggttcctgtattttcccttgtttttggctgccaccttcataaagcatatttgtaagaacggtgggatttttaggcttttggcgtgctgcacgaacactatcacgcatataacttaacagagtcccataagtttttccttctcccttttcaacagcttttataaaactaaatgtcatggctcctgttgattgaatctttgaaagggccttagtgtctgcagaggtttggtcatcttcacatccactaaaggagatggcttcacctccacttgttgctttacagacaccgttttgaggtgtatggtcctcccacgcacaattcccctgcctggggttgaagacacagaggtagggcaaatctagaacagtgccactatggcaggcgtcgatgattgcatgcaatcgagctccgggaggaagaggtcttaccagcgtctcgttgatctcattgtccacaatcatccccgccgtctcaaagtcgacgggcaaaagcgtttcgtcgtacccatctacttcttcaccactgtaatcttcttcttgctgagagccgtgcccagaataatgaaataccaaagagtcccccgctcggcaatcctgaaccaaccaacgcatccacctctgcatattttgtcttgtggggattctt

SEQ ID NO: 10441 - DNA, 823 bp, Picea sitchensis
  Predicted polypeptide sequence is orthologous to G896
ttttttttttttttttcttataacattctacttgtattatgaaaaacaatacaccttcattaacatatcttcttacataataagtaaaattgaagactaaatagtttttctataattgaacactaaatacatttttaataaaaacctcgacatcaaatataatattatttatcaacttttttaatctctttataactctataagaatacacacacaatgtattctatgctagtattttgaggaaatttaatattttacaaatcttccatcacaaataaaatggcttctcattgatatcaaatggaaaagaagatgacaattgtggttcctggaatttcccttgtttatagttgccaccttcaaaaagcatatttgtaagattaggttttctaggttggatttttccttgtttatagccgccaccttcgatatgcatatttttttgaagactaaaaggtttacgaacagcatcactcatagaccttaacaaactcccatacgttttcccttctcccttctcaatcgcctttataaaactgaaagtcatggctcctgttgatgtaatctttgaaagagccttagtatctgcagaggtttgatcatcatcacagccactaaaagatatggcttcgcctcccatcgttcctttccacataccattttgaggtgtatgatcttcccacgcacattttcctttggtggggttgaagacgcagacgtagggcaaatcgagaacagtgccgctatggcaagcatcgatgattgcatgcagtcgagctccgggaggaaggggttttaccagcgtatcgttcatctcattgtc

SEQ ID NO: 10442 - DNA, 880 bp, Picea sitchensis
  Predicted polypeptide sequence is orthologous to G938
ttttttttttttttttctgataaaatctacattatcctggagagctgaaactccctcatttgaaatacctatattgaaatggtcaaattcttgtggtttgcattcctgtacctcagaatttaagagatccaagtcttgtggtttgcaatcttgcacatcattatttgtataaatggaattcggatcatcctcaaagccttcaacatcatactcgctgctgctgctgaacgtcatagacccagcatgcgtactctccgcagcactgattggtggacaagcattagggtttttctggcgagccaatgcctcctcttggttaacaactgccagccaagttgcactttctttagctgtcatcttatcctgcaagcactttgactgcctaacaagcttgcgaattttggctatatcaggtgacatgtgcttgatgacagcagtaagaacccccaccttccaagcctttttcagatcatgaggctttttgtaaggcggaggcccttgtccttttggcaaacctaattgtggccaccagtcctcattagtagttggccaccaaggaggagaaatacccttttctaaaggatatctccgctgaggaggatcacaatgctgcatgagggctgaaagaagggaacccaatgtggtatcctgaagttcctgaagagtatgaggggtaggagccacgaccatgttactctcatttgctccaggtgttgcatgttctgcttgatatttggcaattgcagcagggccgttcctgtcaaatctgaccttctctttccaccatgctctaagattgtcagaggctccacttacaggcttccctttttcaggaatgatgccgtatacaaaaccttgtgctttgcaaacttccatcatt

SEQ ID NO: 10443 - DNA, 334 bp, Picea sitchensis
  Predicted polypeptide sequence is orthologous to G988
ttttttttttttttttttaagagaaattacaagacagaattagtgatcacctttccaaggtggtcaccaaacaaatgtctctaaccacttcctgcatattcacagtaaacctgtgtaagaagttcctgcttgagcttcatttctcagcaacaacccccctgagattagcattttgagtgccgcaacattagagtcctttgatcttttcttgcacaatcacgtggcatcttgtgattggttagagggtccatgtgtctacaccgtaggtgtccacatcattttccacgaaggctgccaactactatgtcacaaggcacctcctcctttcttctat

SEQ ID NO: 10444 - DNA, 780 bp, Populus trichocarpa
  Predicted polypeptide sequence is orthologous to G1006, G22, G28
gatcagatcaaaatctctccctctgcctacacaagtacgagtaaaaatgtacggagagaactttcttgatcagtccgattatgcctttcttgaatctgttcgcatgcatttgctaggcgaacctacttctcctaccactgccagcagctgctttaatccagcaagtactaacagtgcaatgtcagcagcagcagcaaccacccctgctacttgtactccagtccctgtttattgcaggagcacaagcttcagcagcttgtacccttgcttgacagaaaactggggagacttgccactcaaagtcgatgattctgaggatatgttcctttacggtgtcctcagcgacgccgtcaccgttgggtgggtcccatcactcaaaaccgatcaattcattgagcccaatcttccagcggtgaagttagaaccctctgagaacttgacgatatcccctccgcgcacggaggctccgatagctgagccggcggtggttccgtccaaggggaagcattaccggggtgtgaggcagcggccgtgggggaagttcgcggcggagattagggacccggcgaagaatggggcccgggtttggttggggacattcgagacggcggaggatgcagcgttggcttacgaccgtgctgcctatagaatgcgtgggtcgagggcgttgttgaattttccgttgagggtgaattccggcgagcctgccccggttagagtgacttccaagaggtcatcgccggagcggtcatcgtcggtggagagtgcgtccctgaagag

SEQ ID NO: 10445 - DNA, 689 bp, Populus trichocarpa
  Predicted polypeptide sequence is orthologous to G1033
cacgtaaaaatatcctccccccttctctcctcctctttctctctctttcaaaccctatctcagctcacctaccggattcgcaatgaaaggaggtagatcaaagtcagatactaagagcgccaagctctctgtgaccaagaaaccaaccaaaggaggaggaggaggaggagctgcagcccggaaatcaggaaaggcagctaaggatccaaacaagcccaagaggcctgccagtgcattcttcgtcttcatggaggagttcagagagcagtacaagagggaacaccctaaaaacaaatccgttgcagctgttggaaaagctggaggagataaatggaagtcactgtcagaggctgagaaagcaccctttgttgccaaagcggacaagaggaaggttgaatatgagaagaagatgaaagcttacaacaaggagcaggctgaagggcccaaggaagaagaggagtctgagaagtcaatgtcagaggtcaatgatgacgatgaagatgatgaagagggaagtggggaggaagatgacgacgacgagtaggatatggagccggagaatagcttagtcatgtaggttgtgacaatgtttggacatttgatgctaatgactggctattttggttgttaattttttgtctttcagttatctttttaagggaaggatatgcgtactgctccctttgtta

SEQ ID NO: 10446 - DNA, 813 bp, Populus trichocarpa
  Predicted polypeptide sequence is orthologous to G1033
ttttttttttttttttttacagaatataaccacttatctaattcattaaactttggttcaagtaaacatagagttctcccttctacacctattaacttttatccctaggaaggaggaggacaaaataacaaagggagcagttcgcatatccttcccttagaagacagtaattgaaaaaaaaattaacatgccaatactcggccattaacatacaatgtccaaacattgtcaccacctacatgactatgctattccccatgtccaaatcctactcgtcgtcgtcatcctcctctgcactgccctcctcgtcatcttcatcttcatcattgacttccgacactgacttctcggattcctcttcttccttgggcccttcagcctgctccttgttgtaggccttcatcttcttctcatactcgactttccttttatcagccttggcaacatagggtgctttctcagccgctgacagtgacttccatttatctcctccagcttttccaacagcagcaactgatttgtttttagggtgttccttcttgtactgctctctaaactcctccatgaagacgaaaaatgcgctcgcaggcctcttaggcttgtttggatccttagctgcctttcctgatttctttgctgctgctgctgctgctcctttggttggtttcttgttcacagagagcttagcgctcttggtatctgactttgatctacctcctttcatggagaaaccggtgtggggggttagggtttgaaagagagaggaagagtggaggaaaggaaaggtctatgtcttgcccaagcaccttgatg

SEQ ID NO: 10447 - DNA, 811 bp, Populus trichocarpa
  Predicted polypeptide sequence is orthologous to G1033
gaaaaccccttcccctatccctctctttaagccacacacaaacccgcacccaaaattaccaaatctcctcatctcctcaaacaaaccctagaaactctctctccaagaaatcatcatgaaaggcggtagatcaaagtctgattccagaaacaatgacgccaagctaaagagaaaaggagcaggagctggaaccaaagcgtcgaagaaggccgcgaaggatccaaacaagcctaaaagacctgctagtgctttcttcgttttcatggaggattttaggaagcagtataaggagtctcatccaaacaataaatctgttgctgctgttggtaaagcaggtggagacaagtggaaatccttgagtgaagctgagaaagctccttttgcggcaaaggctgagaagagaaagtttgaatacaataaggacatggctgcttacaacaaaagactggctggaggaaatgatgatgaatctgacaagtccaagtcggaagtgaatgatgaagatgaggaagatgagagtgacggagaggaggaagatgatgacgagtaagttgatgacgaggagcggctgaggatgcgaggatgaagtgatgggcaatttggtgtggaattgcttagattgctgtaatcacttgcatttctagcttttaaatattagctccctttttagctgttgtttagatctagcctaggataaaaccaaaggaatagtttcaggagcagcagccctggagctcatatggtggtatgtacttatcaaatattttcatgctcaatgaagtgatttcttccccaaaaaaaaaaaaaaaaa

SEQ ID NO: 10448 - DNA, 889 bp, Populus trichocarpa
  Predicted polypeptide sequence is orthologous to G1048
ttttttttttttttttttggtcaaaattcaaatatggatacgataaagagtttctaattgtcaatcagggaacagcattgttctatgtgctcatcgaaacattcaaccagctttgatcactcagctcaacatgataaagagctctagaccttaattacaaaaccaaatttagagaaggaaagattacaccggtaagtttcatccttggccttgaagctttgcatcttctactgtttgccaaggatatgaatattttacttcctgctcctctttgagccacgttttctggtgctttcttttccattgtttctagtagaacttccaccattgttgactggggcattgcaggctgggggaataggcacatgatgcccaggagccaaagcagggaacccaacagcagggattccaacaagagcacagcagactcctgcttggccgaggtaacaccaaatgcattgcccctctgtaaactaaggcgtagagcatggttctccgcgataaaacactgaagcagcctgtccagcctcctgcattccccttccaaatacctactcttaatttcaagatccctaacatgcaacttcttcctttcccttgatctcaccctcgtgccgaattcggcacgaggctagtctcgagttttttttttttttttttgtttaggaatagttaattatttcaaagcccacccgcccaaccgtagaatattgtgaatttaaattttacgcgattttataagttccgtctgttccaatgtctccatcgaatactttcatccgcttgaagctctaaaatttaaaatatttaggccaatttcaatggattgtcaaaagctgatcaaacgttgatcaaagggattatttttggattgatttttctatttatg

SEQ ID NO: 10449 - DNA, 929 bp, Populus trichocarpa
  Predicted polypeptide sequence is orthologous to G1062
ttttttttttttttttttagttaatgggtatttttattgaaatgctgaaagcaaggcaggagaatatagaatcttgattctttcaaaaattcaaactgatggtgagtttttctgcatgatacctatcctacagcagcctttagaggcaactagctaataacactattggtgacatagaagaccacttcgattgacagaaagacaacaatggagcaacttttcccgtcaccaggcaactgagcttcataacgtttcttcaagttcaactggttactacatcgcgccatggaagccagctgaatccagtaggactgctttaatttgatctggatgcatgtcctgcccttctttgcattgctcagctcggaagatatccatggcaaaaccattgaaacagctaatgacagcttgctggatgtctagcccaaggttatccaaagctctcatagtggagagcaaaagacctggtttgcggccacaaaacatgtggatgtttacagctcgcccttctctcactctaacctcgacccttgcaggttggccatttgggcttggcaatgagccggggcaaagtttgtccatgatacggctgggcagcgctgatggagtcggtgtcaaaggatgaaaactagtggttggcgtcaatgaagagctggggggagttgactccaattcattatggaggtcattaatcctttgcagaagttctttcaagtaatcaattgcatccccaaggattgatgccctatccattttgctgatctttggaacaacagacctcagcatgtacagcctatcattgagcttcttccggcgcctcctctctgccatcaaattcttagctggaagcccccttttcttccccttttgatccacaccaccaccagtaacaccactattcgcctttgaactgtttccaccattcttgc

SEQ ID NO: 10450 - DNA, 916 bp, Populus trichocarpa
  Predicted polypeptide sequence is orthologous to G1078
gctcttacaaagaattcaggcgccaccacctgatacgcgccacccacctacatacgcgccaccgctagtattctctacttagctatataaacttcaccattagtattctttatataacacttcctcttgtttctgaacatgggctgcacggcgtcgaagctagacaacgaggacacagtacggcggtgcaaggagcgccgccgcctaatgaaagaagcagtctacgcccgccaccacttagctgctgcacacgcagactactgccgttcactccgagtcactggctcagctctatccaatttcgcagctggtgaatccctctctgtttctgaccaaacccctgttgttatcctccaccctcctacagcaaccagcccaactcctcctagcaatcctatccctccacgtgtaccaccttccccttccccctccctccaccctccaccacctcctccattttctccttctatagctatctctaaacctccacatattctttcttcaaatattcactctaagtctaaccgccaccgccgcgtcaagcctcagaagcttcctcatattctttcagaatcaagcccttcagtctctccgaaatcgaattatgattatccaactgcttttcaaaatcattcaacttattctacaacgccttctcaagcttcttctgtatggaactgggaaaatttctaccctccttcccctccagactcagaattcttcgctcgaaaagccaaccacaaccacaaccaacagcaacaacatccccatttagatactgatgatgggtcgtcatcagatgcagatgaggatgttgcaacagagagattctcagagtatgacttctttaacgaaaagcaatacacgcagcataagaagcagcagcaacaaaattatagcgagacggagcaagagg

SEQ ID NO: 10451 - DNA, 653 bp, Populus trichocarpa
  Predicted polypeptide sequence is orthologous to G1089
ttttttttttttttttttggttatactgcaaataatacaagcagtctataaatacaatattttctttggatattcatttgcaaggtatacaagaaagtgtacaaaatcctatatcctgctaaacacttttagcctgcatttcggcgctgtgatatgaacctcaagttcctatacatttctgaacaagcttgcgcaatgtcaaacatggctctgaagagctctggcaagcaagttttaatacttgccaaagacttctccctcacctgaaggcgctgcttcttataggcttcttcctcctcttccaagcgctttttcactgcatccacaacaaactgtctatctgcaatagcatcattgtcagatttgtcttctgtcaattcaggatcgaattcagcgggcattttctgctgcatatacttatggtaccagtcttcaaatttcctcgtcttttggaatagttcctttcttgtttcctcacatttctctttcaacttcatctcttcttcttgatgctgcaggatggtatgaattacagaggcaaaattatttatagcagttcttgcaacctcgtccgggagtttgtccaaaaaatcatgccaagcaataagaagtgactggatgggggggttctggacccttggtggagaagaaac

SEQ ID NO: 10452 - DNA, 918 bp, Populus trichocarpa
  Predicted polypeptide sequence is orthologous to G1140
ttttttttttttttttttggattaattaattttttaaaagtttactaaactagcgtaaaatgaacgctttaaggtcgtttacaggattaatgtgtaaattaattcaaggattctttacagtcgatttaaagaagaagaagaccacaatgaaggggattctctgttcagtattggtacatatgttaaaattaaatgttcttttctattatttatttagatcaagctaaaaatacttttgctggatgagcctccatctttccgattcaatcacgaaaaggtaaccctagagtaagaaaaggatcaactgagctcatgctcctggtattggtcaccagagaatctgatgacttgtctggttcgagcaaatgcctttggcctgctgataaattcatcacttgctgcctcaatcgccggttctcttctactaattgctccccctcgttcttgagagtattgatctcatttataattttaccccccttttcttccacgacgcgacacaagcttgtttcgattaatttttctaatttatgtagttcttccaagttcaatccttgtaggtcttctcccctcacctggctcagttcacgggttttctcggctatttctttgttcagcgtggcatacacagcaccatcaggctgcagctcaagagatggttgaccgaacatgtcgatgttctttggatgtagattgcgcttttcaatcacttgccccatgcttgagtttgagtactcataaagcttgccagatgcagaaaacaccatgagagcaatctcagcatcacatagagttgagagttcataagctttcttgaaaagccctcctctcctctttgagaaagtaacttgccttggcgatcgtgtcgtctatcttcttggatctggattttccttcgagtcatcttccccaagtaaa

SEQ ID NO: 10453 - DNA, 902 bp, Populus trichocarpa
  Predicted polypeptide sequence is orthologous to G1140
ttttttttttttttttttgcacaaaatgggctgcaaacccttgtgcacacaataagagaaactccatgagtagcatccggtaaaggaaacagaaatgtttccccgcacttgtccaaggtacacaagtactatgtgcctgagttatgttcctgttctatttatatatacaagcaattatttgtgtccgcatttgctggtgaagaaatctccctgcgatctcccattcagtttgaaaatggcaaccccaacttgagggatgtatcagagctttcataatcatgtagagggccatttgagttgcagacattggttacggactctgatgactgcccttcctcgtaaccaacattctctgaatcagctgtaacatgctttcggccattagatatctccaccacttgctgtttgagtctctcattctcttccatcaattgcattccctttctttgaagatcagtgatctcgttcataatcttctcacccttcttctctatcacacagctcaatccagcctcaagagacttctctagctgcagcaattcgtctatatccaatcctcgcagatcttcccctctcatttgcctcagctgatggcttttctccgcaacttccttactcaacctggagcaggtgctgtcttctaccagctgcaactcaagagatggttgctccagcttctcaagattcttcgagtgcaaattatgcctttccagtatttccttcatgcttgagctggagaactcaaagagcttgccagtggaggagaagatgatgagagcaacatcagcatcacagagaactgaaagctcctcagctttcttgaaaagccctcttcttcgttttgaaaacgtgacttgcctagcggtggcgttatcgatcttttttatctgaatcctctctct

SEQ ID NO: 10454 - DNA, 553 bp, Populus trichocarpa
  Predicted polypeptide sequence is orthologous to G1140
ttttttttttttttttttggctaaattcgtatatattactacatgtttcaacagctccacctcatttcctttaccttaaggaaatatgggaacccttgattcataaatgcatatatacacaaccacacatgatctgtatcttaaaccctgtgaatttcctgaatcaacaagcaaatattaaccacgtacaagccaggatatatgaaggttttatttgaaaaatataacgactgcaaatccattaaattttgttggaaaatcctccatctttcggattcaatcaggaaaaggtaaccccagtttaagaaaagaacaagagttgtcgtagtcctgacgaggataagctgagttgctgctgatattggtcaccatagaatctgatgactggccttgttcgagcaaatgcccttgtccctttgataaattcatcaatctctgcgtcaatcgctggttctcttctattaattgctgctccttggacttgagagcatcgacctcctttagaattttttctccctttgtttccatgacacgacacaagcttccttcaatc

SEQ ID NO: 10455 - DNA, 509 bp, Populus trichocarpa
  Predicted polypeptide sequence is orthologous to G1140
ttttttttttttttttttggatccctagcacacatgagttttactaactacaagcagacatgacaagtgcacatatgaattttattaactacaagccaagatgtaatatattttatttgcaaggagtagtaatacactaataattaaactgatgacttctaagccattaaatattgctggataaccctccatctttcggattcaatcaggaaaaggtaaccctagtgtaagaaaagcacaagagctatcgttgtcctggcgaggatcagctgagctcatactgctgatattggtcactaaagaatctggggattggcctggttcgagcaaatgcccttgtgctgctgataaattcatcacttgttgcttcaatcgctggttctcttctgctaattgctcccccttggtcttgagagcattgatatcctttgtacttttttcctccttttcttccaccactcgacgcaagcttccttcaattaatttttctattttttttagttcttccc

SEQ ID NO: 10456 - DNA, 493 bp, Populus trichocarpa
  Predicted polypeptide sequence is orthologous to G1140
ttttttttttttttttttgatcactttacagttgatttatttaggaccatgttgaagtcccccttacatattttcagttctaaatttcatacacacatcacaaatagcatgatacagtagttcttcaggtgaagaaagcgaatccagcttcattgtcacatcaactcaaacatatataaataccagtatctcatgggataagtcgatcttccagcgatagcagatctgttcctcgcaagattctactggatcagttcattttcctccagctttcagcatcagatggccaaccctaatttgagagaggtatcggagctatcatcctccacaggagggccactgctgcagctgcaaacattggttgtagactccgatgacatcccttcttcctgaactgctgtgtctaaatcgacaagggcgggtccttttcccttgtaaatggttgcgatcttctgttttagttgcttattctcttccaaaagctgtactcccc

SEQ ID NO: 10457 - DNA, 709 bp, Populus trichocarpa
  Predicted polypeptide sequence is orthologous to G1146
cgaagatctgccatcctactgaattcgacttctatttgtgtagtcacgctgggattcagggcacaagccgtccagctcattaccatgtactttgggatgagaacaagtttactgctgatgggctgcagtccctgacgaacaatctttgctacacatatgcacgatgcacgcgatctgtttccattgtgccacctgcatactatgctcatcttgctgcatttcgagctcgtttctacatggagccagagacatcagacagtgaatcaattgcaagtggcatggctggtggtcgaggaggtgctggtgggggtcctcgtccaacgcgtggacccggtgctaatgctgctgtgaggcctttacctgccttgaaggagaatgtcaagcgggttatgttctactgctaggatcgttggaaatcccttacttttcgataggcatttaaattttacgagttgaagctgttctgttcggaaagcgggggaggcccctgcttgctctgaagcagaatatcaagctggctatgctctctgctttttgtgacgtctggccagttgatatttgcttttaaattgccactgatactgtcgtgatcagaaagctgctttctgctcatgctgtgtgtatggcatcgaatatcattgaatcttaaaactcttaatcctcctctggaaactgggatttcatttttcaaaaaaaaaaaaaaaaaacc

SEQ ID NO: 10458 - DNA, 875 bp, Populus trichocarpa
  Predicted polypeptide sequence is orthologous to G1146
ttttttttttttttttttagacagcatcttaaaagtcttagaattcaaggcattcaatgtcacacaaagtttgaagaaagcgaaaaaagcaagaagttttgaacatgtaacccaacgctgacacaaccagcttgatattgcatgtaagggtaagcaggggcctcccagggatttaaacaacaatccaaaagtaagggctgtctcgaatcctaacagtagaacataacccgcttgacattctccttcaaggcaggcaggggcctcacagcagcgttggcagcaggtccgcgagtggctcgaccacctgctcctccacctcctcgtccagcagccatgccacttgtaagtgatccgctgtctgatgtctccggttccatgtagaaacgagctcggaatgcagcaagatgtgcataatatgcaggtggcacaatggaaacagaacgcgtgcatcttgcatatgtgtagcaaagattgtttgtaagagactgcaacccatcagcagtgaacttgttctcatcccaaagtacatggtaatgagctggacggcttgtaccctgaatcccagcatgactacacaaatagaagtcgaactctgttgggtgacaaatttttgagtccacgacagtgccaggcaatatattcccgctccggtcaacagcattacggtcacggtgatcatttgcgaacagccttgtgtgatgacgcttctgaaccacaacaaatgtcactggaggctggtagttgggctctaaagaagcacatgccttacgaatagcatcaagttcgtgcaacaaaacttgatagaactgcccttcactgacaccatctctgtagaatataattctctgaggcttctgccctgtggctctccggaa

SEQ ID NO: 10459 - DNA, 733 bp, Populus trichocarpa
  Predicted polypeptide sequence is orthologous to G1150
agaaccagttttctgacgaaaatataccccctgggactgtcgtggacactgtgattacacatccaagggaatttgatttctatctatgcagccattggggagtgaaaggtacaagcaggccaacacattaccatgtcctgtgggatgagaaccaattcacttctgatgaactacagaagttggtttacaatctgtgctacacatttgtaaggtgcaccaagccagtttctttagtgcctccagcttactatgctcacttggctgcatatagaggcagactttaccttgagcgatcagagtgcatggcttccataagaaatgcttctacaatctcaagagcagccccaccaaaggcagctcctctaccaaagctcagtgaaaatttaaagaagctaatgttctactgctgatttttgtctaagcctatgaattcttcaattaatgactggcatcaatacaaacagcacctagctccaaatgtagcgcagcccatttatcactttagtggctggatgccaacgcttagaacttgcatgatgttaagaacctcctcctcgtagcaaaacaagaaaccaagagttgtgcatttctttgtcaatgaactatgacgcatgttcttgtttggcaggaagttgtctgaatggcagagacttgcacaaacagcgccattctttgtctttacttattttccgcgaagaagcaaaactattcccttaaaaaaaaaaaaaaaaaa

SEQ ID NO: 10460 - DNA, 797 bp, Populus trichocarpa
  Predicted polypeptide sequence is orthologous to G1198, G1806, G558
tttttttttttttttttttttaaaccagaaagactcgaaactgtagctgatttatgaactcttgaccattatacaaatttcaaggttttatggaatctctatgttatagatgacaaatataaaaacaattagaagcatacctggcgaataaatccctcaagggtacctagctttcccatggccatggccatctgacccatgtaatttgccacatttccagatggccctgaggagccaagagatccgctggacaaagtctcagagagggactgctgcaatgcctccatcccttgagataatgcatcttccgcctgttgggaggactgctgtaagttgccaatgcccaccaactgctgctctgttaaaggctccaattgattcataagaagcttgaggagctcagatgaacggaagccaccaagccacaagaaacacctctctgcaggtgtcttccacatgccagacagcaaatggaaaacatcagccttggctgcgttgctcttcagcttgaaaacttcatcatagtgagccattataccatcagtgatataccgaagttctgcatcaccagcatgagaattgacagctgatctcaactcattaatttgtcgattttgctcctccagccatcgtgcatattctacatcaaatgccatgggccccatttccactcattgaatgagtttggtctcctgagcttgatatgaagattccctgctgccgtgcccgttggagctctgtttcagttggctgagcttaagcggctactctcagctgctggaatatgctttcttcct

SEQ ID NO: 10461 - DNA, 875 bp, Populus trichocarpa
  Predicted polypeptide sequence is orthologous to G1198, G1806, G558
ttttttttttttttttttggagtacaaacatagcctacatttcaaatgaaactttctaacacttttaactatacatcctgcaccgagtatcaacttaattacctaaatttgctgcttcagacacaaatcattacgattcatatttacatctgctttggaaaaacatataactggatcgaatacttgtccgtattacaaatgccacaagaacccgttcccctgcagagggcacaagtgctggtggggatcaatatagatatagtggttttctagggtcatacctctgctgactaggcaggttcacaaggacgagcagcccatagagaactgagagtacgaagacggtggaagtactctcctaatgcaagtaaacctcgggctgcttggcgtattgttaagatccgagacatgtggtgcagagtttgttgccgaaggtgatcagcctggttcacaaatccctcaagctcgtcagccatcttatccccataacccccatcacccattacatcagctgctatgctttgggacagagtctgctggagtttatcaattccttgagttagagcatcttcagcttgctgagaagattgacgaaggttacagacatccgcaagctgttgatcagtcaaaggctcaagttgtgacatgagaacatttagaagttctgatgggcggaatcctccgatccacagaaagaagcgttctactgatgttctccattttccagaaatcagatagaagacatcagccttcgcagcatctgttttcatgcggaaaagattgttatagtgattcaagccattctcaactaggatccggagctcaatatcagttatacgagcttgcaatgcattcctaagttcagaaatttgttt

SEQ ID NO: 10462 - DNA, 905 bp, Populus trichocarpa
  Predicted polypeptide sequence is orthologous to G1198, G1806, G558
ttttttttttttttttttgtcgaattattgccactagatgttttataacaagaagataagcatacatctgtgtgagcaaacctggcgttacaactgcacatgaaacctataattacaccaactatggccgctatttgttttacagcaagaagataagcatacatctgtgtgagcaaatctggcgttacaactgcacatgaaaccaataattacaccaattgcgacctatccgcaccacaattaccaccgatgatgatgactaagaccaccagcggcagtccacccaatggcatgatgagaactgaaggccaagtaggagggtggtgaagtggtagatattcatgttaattttgttggggggcaacatactgctactcattcctgtggccgggccaaccagagagaactaagggctcgtagcctagagaaatagtcatgtatagctagaagagcacgggctgattgccgagttgtcaatatacggtgcatttgttctagtgtttgctgcctcagattatcagcctgacgaaggaatccctctagagttcctagctttcccatggccatggccatttgacccatatagtttgccacgttcccagaagaacctgatgagccagggttgccattagccaaggtttctgccagtgattgctgcagcgcttccatcccttgtgagagagcatcttctgcctgctgagaagattgttgcaagttgtaaatgcccattagctgttgctcagttagaggctccagttgattcacaagaagcttgaggagttcagatgagcgaaagccaccaatccacatgaaacaacgctctgctggtgtcttccacatccctgataggatgtggaaaacatcagcttttgcagcagtgcctttcagcctgaaaacatcactga

SEQ ID NO: 10463 - DNA, 896 bp, Populus trichocarpa
  Predicted polypeptide sequence is orthologous to G1226
ttttttttttttttttttgccttattacattttcttgttttccatagaaagggcagagtacagtaatattagtaatcctataaattcagctgtaaatttgatggctctcttgcctagcagaactcctaagtcctatcatatatagacccatcagctaaccgttgatactgctgaatatttgatgagctgctgctgctacctcatccgttgatcccagcttacaattatcctctaacttaagattgaaagagtaaagaactgttgcttgagaagaagtgatgttaaggtgcaaaaccgtaagccccaggtcctccaatgcaacaatagctctcaacaactgcccaggaattctttgacactttatcttcaaatttacatggttttgtactgcagccacctctatctctgttgcctccgatttcttcttcactgttctttcctcttcacaagtgcctccctcctccaacagaaggtcacattgtggctgcgaagtacagtagtggttgggagaaatgcccgcggtggaggctgtttctatttctctaatttttttttgtgcctcaagagattgaacaagctgctctagttccttcacaaagtctattgcacctcctatgatcgatgcttgatcacccttttgaatataagatggtgtcatgagagagcggagagagttaagatggtcgttcattaggcgacggcggttgcgttcaacagcaatgtggttcatgcgttggctctctacttcttctttgttcttggttgcccttgtacgttttctctttcttctttctcttgtgattattaatgtagaggattcggagaaatgggttgtcatattaggcacggtttggggctgagccctccatggaattgaagagtctgaattgggttct

SEQ ID NO: 10464 - DNA, 557 bp, Populus trichocarpa
  Predicted polypeptide sequence is orthologous to G1246
gcatccttacccattttatgagtggggccttttaactttctttaaagccagcccagacaccctcctttgaacttcactacttcggcaacattaagcccctcttcagaaccagacacaaagaacctcaggagctaaaacccaaactcctctctctctctctctctctctctgccttaactacagttccttctgagacactctagcattgatatctgcaaaaggagcccatgtcttctctttccttttgcttctcatgagaagcaaagtccttttttctcaccgtgttttgtttcgctctctcacaacgaagtcatggaagagacagaagagtccagtggtaacaagaaatgcaccaccaagaccaggactttcagaggaaggaccaacactcacaagcatcattatcaccagtatcagtatcagtatcaatatcactatcactatcagcaccaactcttgcaatactcaaatcaatatggtttctttaaccataaccagtacccgggttactacccagctcttcttcctttacctccaccaaaaaaaaaaaaaaaaaa

SEQ ID NO: 10465 - DNA, 825 bp, Populus trichocarpa
  Predicted polypeptide sequence is orthologous to G1246
ttttttttttttttttttattcttttatagcttttttagttgttagtcattgttttttaattattatttatttatttaaagtaatttataacattagattattttttttcaattttatttaaaaaaaatattaataagtgatttttagcttgattttcatgaccaaatataaaaaaatattttacaactaattttctatgaaataactatccactaaaaaataattactttacatgaatttactttacataagaactactttctaaaaaaaaaaaaaagtttccggcaaagaaactggcctaaattaaaatatcaagtggcatgtgttcattttccgatgcatgcaatgcatagatttatggtaaaaccgtgtccaccactagtatattgagactaaatcgccagtaatgttctcgtaaaacacggatctagatccaattacacaaacacttggcagagaggttttttttttttttattaacagaattcattgattacaaattcatgaaagaaaaaaaaacaaatcaaggagaatattatttgacagagaagacaatccagagtgtctgattgcaatacaaatgaatggagaattaaacacacgcagagctctggaaatcgaaaacactacgagtctttgaagttgatactgcagttgatggctgtgtgtgtgcgtgtgtgtttgggacatgaagctatgtggaaacagaggagctaatcaatgcaaggggatcaaatggtagaggtcgccatgccagagtgaggagaaagagaatacctgaagaagcagaaccgtgagcgcatgatcggttgatggatgttgaa

SEQ ID NO: 10466 - DNA, 931 bp, Populus trichocarpa
  misc_feature (830)..(830): n is a, c, g, or t
  Predicted polypeptide sequence is orthologous to G1249
ttttttttttttttttttgtaaggatacaaattgagaattttaaaccattcagtaattagcaacacacatttagcataaattacttcagaatgattgattacttgactcattgccactctacatggcgatgaaccggccagggatatctacgtttgttaattgagcaaattccatattgatgatagcattgttggatgcgcatgatgttctcattgaattttatgcgctgactatcttgttgtctctacagccagaaaaaatgtcaggaacgctgaaggagcagctagatgcaatcaccccagctctccgggagatgcgtctaatgtgtggtgagctggcctttgcatcacaggaaaagaaggtcccaagctatgtagttgctgggcaagaaaatgtggttgggtcaaggccagacaccagcagtcgacgtctttcaaacaggagcttaaatggaagcttgagcaatgcaacccctttaaacagaaggctttcactttgtctccaacagttgggaaccaacagcatcaatttttataaaacttgaatatttgccgccttggtgacgaaatgatcgatccggcgagtgccagccggggctggtttatctgccaaggtacgagcactagttttgtcactcgcagacttctccggtgattgaactggcagaggaagagattctaagagggtggtgccttttaacatcgactcaaacgtggtcgagtttcagtctttagcttcagctgttctcgattgcagtttcagctgatttctcggagaaacaactcggtggagctggagacgatgaaaagagcatctgggttgaccttgntgatgtctttgtcgagattctcttgatccgacctgctggggattcgggtctggttgttgttgttgcttctgtgttgttctgagaatgtgaattctattggg

SEQ ID NO: 10467 - DNA, 842 bp, Populus trichocarpa
  Predicted polypeptide sequence is orthologous to G1266
ttttttttttttttttttctaacactctaaagatgcaattatatttgtgcatttgatgcactctaaaaccatacaaactgacatcttctcatatacaaaacccaaaaaacgataaaaagaaaaaaaacacaagacaaaaaagaaagaaagaaagaagaacgattcaaaacgttccaggtagagatttccctcgctatctcaacaaaattaagcaaaagcgagtaattaattctcgaggatatccgacccctgacggcgtgactccccacttgtgctgctctctgattcagattgtgatgttgcaatagttattgtgctagagctaccgcatgaatccatagcttttttacttgacgtccttgttgagctaaaaattggctgacagttttgagttgatatagcagccaccacttcagctggaaaattaaggagggccttagagccacgcatgttaaaagcagccctatcataagccagggcagccgcctccgccgtttcgaatgtgcctagccatatacgagccccgtgtcttttggagtcacgaatttctgcagcatatttcccccatggccgacgcctcacgccccggtaatgcttctttgctatgactgtcctcgctggttggagcatgcctgaagtgttgatttggcttctcggaagtatattatatgtactgctattcggggcgctggcctcgttgatcatctgatatatgaccatgtcttgtgagtcattctcattaaaggggagctcatggatctgggagcttaataccatggtttgcttattgctcggaaggggatttggctgcagttgatttcgtgggatttttggggtttcgc

SEQ ID NO: 10468 - DNA, 844 bp, Populus trichocarpa
  Predicted polypeptide sequence is orthologous to G1266
ttttttttttttttttttgtattagaaatctagagtagattaagtagatgatacaagactcactttatcctctaataaatgaaaaagaaactttacagagtgtgtagaaataaggatggacaacaagaaaggaaagaaactcttgccacgacattacccctctcctcatcttaggaaagacaagggaaaaagaaaacaaaatcaaaggtctgcaaagaagaaagtaattgacaaataaaggaattaaggagatgaaagcagtctgacttcaccaagaactagagctctcacatgaattcagaagctcttcaaggtagtcagctcccaaatcctccaaaaccaccacattttgttgtctagtattagctacttgattcactttacttttcctacttgttgattttcttctcacggagtgtctcctcttaagtgccaccacaggcgaacacccatcttcacatctatacttcatgtcttcaagtgattctctcaccatctccacagagaaatttagtacagccatcgaaccccgcatggaaaatgctgcttgatcataagccaaagcagccgcctctgcactatcaaaggttcctagccaaacccggacgccatttcttgtagaatcccttatctctgcagcatacttaccccatggccgcctcctaacccctctgtaggatttctctttctttggctcctcttctttggcatttgaagtcacttcctcttccttaattccactcgaggaattagattccgaggactccttggcaccatcggcgcctaaatcattaaacagtaccatctcccctgagtcactggtgttaaaaggaagggaactgct

SEQ ID NO: 10469 - DNA, 635 bp, Populus trichocarpa
  Predicted polypeptide sequence is orthologous to G1272
ttttttttttttttttgagaaaacgacgttcctggagcattcagattacaaatttcaagcatgcataaagcaaaatcatccacttacaaaataccatataacccaggatggtgcatgcaccggattttgcttgctgacgttgtgtacagaaacatgaactgaacaaaatgcaaagctgtgacaagccatcagcaagtgaccatacctagaggcagtatccaagattccaaaacgtgtcaaatggcatcaccatgcctaggtgtagtaccacatatttgctgacttggatccagcacatggtgttcaactaaactccaccacagcaaggctgcaccaaattcagaaaccccaaacacctgctgtctatctagttttatttacatagagtaaaaggctagcatgctcaacaaaagaacatcgaattgcaaactttctcctgcaacctcggtaactgtgggacaggaacagctcctgcagaggtcaccccaccatggcttgaggaagtctcagaagtatcttcaaacttcataaactggcccatttgagtagctgccaggtgggcatagcagattggtgcaactacagagatggcagtcgtgcttctttggtatacatatgagagggaatgcacaagc

SEQ ID NO: 10470 - DNA, 840 bp, Populus trichocarpa
  Predicted polypeptide sequence is orthologous to G1273
tagtaatataagctgaaagaataactgttcatgtgttgaattgtgtagaagatttcttgtttccaagggttatagattgaataatgttatgaactgagatagtagtaaatgagatcttgtggaagcatagaaactccttactagctcttacttattccctttctgtataatgcaggtctgagaggttgtcccagccaacagaagcgatttcttagtgtctacaaatcaactttccatctctgcagcttttgttacatcctgttgaatgtggattgaggttcaaaagataggacttccaagctcccttgatcttgaaatggccgtttcttacacgtttaccagtaaaatgtaattaacattccagatatttattgaaaatggagatcaaggaatcagagagggtggttatagctaaaccagtagcttccaggcctagttgctccaagtttagatctttctcagagttgcttgcgggtgccatcaatacttcaccctctactgattgttctgaaatggcagttgctgccattagaccaaaaactttgaggtttaggccaacagtgaatcgtgctccaggtgcattggtttcttcccaggttgaactctctggaacaacacttagcaattcatctaatagagtttcaagtactgatagcaaaaccactgtcatatataaaccacaggcaaagtttgtgtcgaaggcaactgtttctctactggcgagtatggggaacttcaataccaattcacagcaaatgctacaatcagttgaggctcgccctcagtgtccaaaacaaaataaacaaaatttctcatcccagctaacctcaaatcttcatc

SEQ ID NO: 10471 - DNA, 888 bp, Populus trichocarpa
  Predicted polypeptide sequence is orthologous to G1273
ttttttttttttttttttgacttccttcgaaacttattctgaagctaaacaggcgtatatattacacaggattagccaaggcaataactgagagagagggaaatgtactcgtaagcttaagataggccagcaaggataatgaaaacgagacagccatttcgatattaatcctcgtcaccaacacaaaaccggcaccacgaagaagcctccagaactgaaactgctatgttcttgttttttattgtctatttgcttgtgttatttagcttcttgtgcgctgaactctttttgatatctgggacagaacaagcatcgagatttcgcccatccatggttgagatcacagcttgtctctactaggaggtgcctgtagatcagggttcaaaggctgtatatttgtactcttcagaggcatctcatggttatgttttccttcatatgttgtaataaaagcttttggatcgtctgatgctctttccacatgcttgcgcacattgcatttgagactagtacatctatagtaactcctgggatatggattcccccttacaatcttctgcccatattttctccagcgaaaaccatcccccaaaatctcagaatctgtggaactttgcaccactacacggggctcctgaacgccctcccctgatatgccacctttattggattgtatcccagctttccttcttttatttctaggttcatcatcgtctccctccaatcccttgcttccatcattacattccccattgagaccacatgagttatcagaagttcccgcaccagcattaattgatccagttccagcacgatcacaagatggcggaggtttaccctggtaaaatgaatgcacctgtaatcctgtttcgatctgattttcctctc

SEQ ID NO: 10472 - DNA, 877 bp, Populus trichocarpa
  Predicted polypeptide sequence is orthologous to G1324, G2893
ttttttttttttttttttcctttatgaaatatcttgacaattgataaatgttggcacaggatcaaaatccacagttactgtttaaaatttggtacaaaaattaacaatggcttatcacacaattacacaactaatccaagaaatataaatttgtcgctttcgtgactaagtatttgtgggttattccaaaaacaagaccttaattttcctttccttgcaagttcctaaattgccataattcatccatgttccacatagtatctccgaaatcgtatgcaccccaatcaccatcttccatgtggcgatcgccagctgagatcccaagttctccaggcactggcatcgttgctaggttgatggcttccatgtcatagcaattgctgtcaacataatagcagcccttcgccaaggtgctgtactcactgctgttgttgcctatggcttgaaagggacttgtagggtattctgataattgagacatttgtgagacattcattgattctgctgaagaaatgcatgaacttgtgccaagctctgagtctgaggtttgttcatgaggctccaaataatgcattgtcacactcatatcaagaggagcttcttgctgctgtactagtggggggagtgctggcgggaacgttgaaaactgaggagcataattgaggttcggctgagaaactactgctggtctttgggatggcatggctgatgaagatgttgacgatcctcctatcttttgaagcaatcttggcatccaaaaccacctaattatattctgaaatgctgtgctattggcatctatcttaaggtgccttgcttgtttctgcactctagttctccaatagttcttgatttcattgtcagttctacctggcaa

SEQ ID NO: 10473 - DNA, 589 bp, Populus trichocarpa
  Predicted polypeptide sequence is orthologous to G1341
ttttttttttttttttaaatcacaatatcaaacatggattaaaacaactagctgtctacaagaatatgatacaactatttaagaacctcactatgcaattcctttttttagaaacaaaggattggaaaagcctgcaagattctcaaaacactccagtagttctattttcacctattatgccttacaacttggagcccgggatcccatctcttccatataggatatgttactatcattattctcttctgtttttgcatttttcatgtacgtaccgagatcagaatacatctttactgttgccttcgaaaactcagccaaggactcaaacactgaagaaaatcctctctgaaatccatttatggtgatcccatgtgtctcttgcatgctagcaaggtgctttccctgctcttcatctagcctcttcctgaacatttccaattgatttttcctttaagctatgtattctatgcagttacgcgccgtcaatttagattcctgctcagaaatcttggattcaagaatcctcctctctgctctctggaatgccagagtcctcctgtcaagttctttggccaatccatcaactttc

SEQ ID NO: 10474 - DNA, 685 bp, Populus trichocarpa
  Predicted polypeptide sequence is orthologous to G1341
gaaattaatgtgaaggtgtcagtgcccctgtagttcaggttcagctatgagaagcgtaaccagctggtgtactgcctgcatcccaggccgtaagcagaaagaaaccaagactgaagaatcggagaaatctttaaggaaaaaaccttcccgcgaagaatctagtggtcctgatgaccaagctgaaggcagcagccatcaaggaaccacccatgctgccagtagtgctgatactggtggcgcagctgttgtagttatgactgcaacccaaatgtctgacatggaaggtagttctcatggcggcggcggcggcgggggcgacggaggtggcggtgacggttaaacattaagcagtccccgtttgattgtgtttgtgactcttttgattgatatcgtaatggttttttctcttggattattatcactgctgcttgcttctttactttccttgtttcaagttattgctctgcgtggctacaggaatgcgaaaccaggggatctgggatggaatctgtaagatgttgaaagccatggttgtgatgagcgcgatgtttttttctttattttttagtattttcctggtgtatggtgtttttgaggaagagaggggatgcatttgtgctctatgttcagatctttcaatatttatttcccacataatatttttgttagaaaaaaaaaaaaaaaa

SEQ ID NO: 10475 - DNA, 885 bp, Populus trichocarpa
  Predicted polypeptide sequence is orthologous to G1364, G481, G482, G485
ttttttttttttttttttgatgatgaaggcaccaaccaaattcaaaccacccccaacaaacaaccaaaaaccaaagccaccaaaatatatagggcactttggttccaatcagatcaactaatgcgagagattagattctacaagtgttggaactaaaaagttttaccaacgttacaacttacaattcactgaattgaccaaagcaaagccaaaccctactcgttgcctggcatggaaggaaggatcatatgctgtccctgcacttgtggactcgtatagttcatcgatccttgaaaagcaaactgtgcattttgaccaggcagacctccaactgcatcccgtttagaagatccatctccacctctagcagacccctttgcatcaccctccaactgtgacatggcagtgatccaataaaaccaatcggtgaaagagaaggaaagagaagagtcagatgattagattacaaaccaacctatatgtaaacaaaataaatcatagacaagaaaacaaactaattacctcccggtacctagccaggtacaccttaagtggctcaatataatcctcaaatcctaacgttgccattgcccacaacaaatcatccccattgatcgtcttcctcttctccttctgacacttatcactcgcctcgctggtaacaaagctaatgaactcagaaacacattcctgaacagtatccttagcatccttagcaatttttccattagccggcaacgccttcttcatgatcctacttatattagcaataggcaggtatctatcctgctctctcacccctgaccgcgggctctgctcaccaccactctcgtggctccccgccgccggactggtcggattatcggccatcttactaaaaaatct

SEQ ID NO: 10476 - DNA, 849 bp, Populus trichocarpa
  Predicted polypeptide sequence is orthologous to G1364, G481, G482, G485
ttttttttttttttttttattcttttttttttttttttttttttttttttttttttttttttaaaaaaatcaccgcatcattaaaagatgccccggttttatatataaaaacagagggacatacccttgccaagtacccattctaaaaatcaagacacaagttacaagttcccattatttacaatgcttcaagagtcattctacctccgatagatacccaaattatacaaatcttaccggaaacaacccaggatacaacaagtgaataaaaaccactcaagctgtcagtgcttacaccataccaatgttttatgttttgaaacactattggttctaggaactggatgaaaaattcaataccgtctaaatgacaaaattcattgtaaaaaagcacatatctactcgttgctttgcatagggaccatcatgggcggagcttgaaaatttgaatttccataactaacaccttgggagaaaaaaccttgatgaaaaatctgcgcatttggaccagggggaatatcctttttagcaaatgtatctccagtcttcgcaaatcccttggtatcaccctccatctctctgtatcgagacaggtaaatcttaagaggatcaatataatcctcaaaccctaacgtagccatagcccaaagcaaatcatcaccatttatcgtcttcctcttttctcgctgacacttatcacttgcttcgctagtgataaagctaatgaactcagaaacacattcttgaacagtctctttagcatccttagcaatctttccattagcaggtagcgctttcttcataatcctactgatatttgcgatcggtaagaacctgtcttgttcacgt

SEQ ID NO: 10477 - DNA, 704 bp, Populus trichocarpa
  Predicted polypeptide sequence is orthologous to G1364, G481, G482, G485
ttttttttttttttttttgatgagaaatctggaaaatttatttgccaaatatcccaatataagatgattatgatagggttgctaaaagttagcactataaaataaagacaaggaggtacgttgattgactaaaaacaagaaatggcagtaactcagcaacataaagctccatttcacctgcgcatttggaccagggtgaacatcctttttagcagatgtatctccagccttcgcagatcccttggtatcaccctccatctctctgtatcgagacaggtaaatcttaagaggatcaatataatcctcaaaccctaacgtagccatagcccaaagcaaatcatcaccatttatcgtcttcctcttttctcgctgacacttatcacttgcttcgctagtgataaagctaatgaactcagaaacacattcttgaacagtctctttagcatccttagcaatctttccattagcaggtagcgctttcttcataatcctactgatatttgcgatcggtaagaacctgtcttgttcacgtacattagaattagagcgaggactttggtctccgctctcatggcttcctccccctggactcgccggtgcctctgccgccatatcgaaaaccctaactcaccaccaataatcataattgattgatcaaaacagcaatcagaggaagataatttagagagggagagagagagaga

SEQ ID NO: 10478 - DNA, 916 bp, Populus trichocarpa
  Predicted polypeptide sequence is orthologous to G1364, G481, G482, G485
ttttttttttttttttttggttctaaagatttgctcgatttagaaacagatggaatgaccatcgcttcccttttttggagtacagaggttgataaagagaaagtaaggattaacgaagtgacaaatggcaaactaaggacataaattcacctttcctaaaagggaaaggtgggcaaaacctaagacccttcctcctctcttctctctttctttctttcatctgtcagaagaagctcaaattaagccgtcacttccactacttccaaaactcccagggatcttgatgccacaattatcaacaataagaacagaaaggaaaagcatgcgctaaaatcttgatctgattaacattgaaaacgaaaggaaatcaaaacccttttcattactaaaacttgacagctacgtactactgatcaaagagggaaagtaatgacgggctctctctacatgtgaaaacaatacttttatcatcgtactagtacagacattcgtttctgttcttttccatcaattagcaagcactatttcaagcaactctgtcatcagatgttccatcgcattactttcttcttgtactactgctatgcaccatcatcaatacctaccttgaattaccttgatgatgaaacccaccagcaccgtacacgtgtccttgatggtgatgacccatcatcatcatcccgccatacatcccttgccccccaccaccattaaaccctccacctccaccgccggtggaattagccccgcctccacctcccgcagcaccactcccaccagacccaccaccaggaccatccttctcccctgctggtcttcccatggaactcttctctccttccatctccctatacttctgcaagtaaatcttcaagggctccacgtactcctcgaaccctagcgtcgtcatggccca

SEQ ID NO: 10479 - DNA, 645 bp, Populus trichocarpa
  Predicted polypeptide sequence is orthologous to G137, G145
ctccgcgtttttttttttttttttgctcagtaacttcattgttggaaaagaagcaaataatcatagtagaaacaaattaagtcttctcaaagttgcttgcaataattatgaacttcttacatgcctcttgtccctggcgtaaagttctgaaatccagtcacagaagttttcatgtccaaatgaaagtacacatgctcttgaaatcatttacacaatacccacaccaagagagaaagttacatagtaggtgttcctttatgagcaatgaagagcacgaaactcaaagcatccatcctggaatgaacccatggacttgctgggtggcatgtgttgttgcagtcatctggtctgaaccaacaggggtgtagcctatttgcaaagtgggattgcattctaaagcctggaatagcccctgagactgagcatgctggtggccgtaggacatattttgctgatcatcaccttcccatgatgggcggaggctatttcttgcactgatttcatccagctttattgtcaaacctctgttagctttcagcaacagatgttccttattttgaagatcagcaagttggtcgagcatatactgggtcttagttgaccgaacttggttcaatgacgactctaactgacgctcgagctgct

SEQ ID NO: 10480 - DNA, 919 bp, Populus trichocarpa
  misc_feature (816)..(816): n is a, c, g, or t
  Predicted polypeptide sequence is orthologous to G138
ttttttttttttttttttgcaatgacggaaaaataagcttttgatttgttggaaatgcttggaaacaagagttaagatgcttggtcgtctggaggaaacttatgcacataggctcagataagatagagaacagaggcataaacagtggaaatgcaactttggcagcaagacaatgaaggtaaatgcaggctactagtacatgcacgtgagatcaaagaggtaactactagagtgtctgccattgtggcgcacctccagcggtaagttgtcacacatgcagtgctgccttactatttaagcaaacacagtgttgtttgttgtggaggatgacccaaagggtgatccaccttgccgttataaatttcaccaccattcttcattgctacaatctgtttctgtagcagttggttttcctctttcagcatcttttccttgtcctggagagacttcaccgaatccagcatcagttgcatctttctagctctgacatatgttagtgcagcatcaagctgtgtcgcttgttgcacaaactcactcaaggtctgctccccaggacatgtaccttcaagtttcctttgaggtatttgcagtatctccgcagctgatttcaaatttgcgtatttaccaaagtatacctctgaatcattagcacctttagatgaagtagccatcacttcagaatgactcttgtaacgctcgaggattttggctatactgccaacgctagagaattcatagagcttgcctccatttgaaaaggtgaggagagctacttggacgtcacaaagaacagagagttcgtgagctttcttaatncatccatttctcctctttgagaaagtaacttggcgactgctcttgttttcgattcgttttagctctactttcttacgacccattctctctgcctatctatctc

SEQ ID NO: 10481 - DNA, 889 bp, Populus trichocarpa
  Predicted polypeptide sequence is orthologous to G1382
ttttttttttttttttttagaccataagcaaagatatatatagagcaatacatattcttaaaattcagattctaaccttttgccatttaccagctgtaaggcaaggatgcgggaaacaaatttaaaactcagacaaacttatggacccgttaataatcttcccatgttctgcggatatggataaggtggaatttcaatgctacggctttcacctggaatttgcctagatccatactgattcatgccaccatttaaaacaccatagtaagccgtaattggggttgcatgaactactctgaaactagaaccacttgcttggttctcgtgtttgataagttcagcatgcaaagcttgttgctgatcgctggactggttttcagttgtagaactgatcccgaccccaagatcaaggctaattgtctcgttttcatctggtctaatccttgagggtccattcacagctgatggtcccgccatgtcatgactgtttgtcctagctgtaggtacatcatgattgtgtttcccctcatatgtggttataactgcttttggatcatgcgatgccctctcaacgtgctttctaactgggcatccagcatttgtgcatttgtagtaactccttggattaggatttcctctcaccactttctggccatatttgcgccacctgtacccatcatccagtatatcaacctcactcagagtttgcacgacaacacgtggttcccggataggtttgaccactggagtaacatcaaaacctccagcatccaacctccttctttttgagaagggatcatcatcgtcttcggcaccttctccagtatcatcatttgctccagtagacagttcaggggcaccatttggctcgatagcatgaggcacctgt

SEQ ID NO: 10482 - DNA, 325 bp, Populus trichocarpa
  Predicted polypeptide sequence is orthologous to G1419
ggaaaagacttagagagtgtgacgcggaagagagagaggatgttaagagggttatgcgagtggttaagagagaggaacccgagagggatgttccgctgacgccgtcatgttgtacggctgtgtgggatatatgtggcgattcaaagggtgtatttaacgtgcccccattgtctccgttatctccccacccgtcgttgggatttccacagctactggttatttgattagaattgaattgccgttaatctttttattaattatttactcgagttttttcttttaagtgtatatatagaaacagaggaaaaaaaagcatgcaatgtaa

SEQ ID NO: 10483 - DNA, 519 bp, Populus trichocarpa
  Predicted polypeptide sequence is orthologous to G1419
ttttttttttttttttacaaaatccattccattgaataaatgcaatcaaagaagaaatgcaatcttacaaaacttatcatcttcaacaaacgcaatcatagttgcgtatatgaaccctactaattatatatagctatgtatagaaacttcctaatctctacttaatcggcgacacttttggccatcagatttttcctaattgagtaaacagcaaaccaaccatccaaacgacatgttgaccgtcaatcattcaaacaaccatcagccttgaatacccaaatgaaggatggggagataacggtgacaatggtggcacattaaatatccccatgacttcaccatcccagaaccccttccaacttgacggcgttaatggttccgtagccgctgctttgacctcagtttccggcgaagaactttccctcttcgccaccttattagtgatcacagaaccagtactttccatactactctctatttcttcaatctttcttttcttgcttgaagtttccaagaatt

SEQ ID NO: 10484 - DNA, 807 bp, Populus trichocarpa
  Predicted polypeptide sequence is orthologous to G1419, G43
gcccgaaccctcaatttatccccattaatgaggtttggataagatgacccaaatccagctccaaaacttgggtaaaaaccgtgtacaatgatgctccatatgctgtaaccttgctgcatctaataaattcagggagtcccatttgatgttgatttttcaaagcaaaagtagcaacttgaattcactccctgcatataaaaaactacttgactaccacccatacatccactttttttgctcattttttctgtctttaaaaaatggcaaccccagaagaatcctccacgttagaactcataagacaacatcttctcggagacttcacctccacagatgagttcatcagtaatcttgagtccactgtagccagtatatctgttaaactagagaactccctatctgggtctgaatccaactccccagtatcagaccaaagttactatagcacccaagaaacctgtagctttgaaataaaatctgaaatcatagatttgacacctcctgaacccatgttttcagattcaagtaatcagtccccaccacctgaactcgtaaagatgacagatagagaagagacaatattaaggcattacagaggggtccgaagaaggccatggggaaagtttgcggcggagatccgtgacccaaccaggaagggtagtcgggtttggttaggtacttttgacagtgatatcgatgccgcgagagcttatgactgtgctgcattcaaaatgaggggcaggaaagcaatcctgaattttcctttggaggctggactgtccagctcgcctccggccacgggcagga

SEQ ID NO: 10485 - DNA, 905 bp, Populus trichocarpa
  Predicted polypeptide sequence is orthologous to G1421, G1750, G440
ttttttttttttttttttagacaattatcgccatataattcactaaatatggactaattaatactccactatatacttaaactccgtagtttgactaatcaaaccaaaaacttgacataaaaaataaagggacactttaggtattccagctctatatcaggcgccctttctatccacttggcgcctttaatcacgaatcatggtatgccacatcccgatagggttgtgtcaaattacaaaagactccccaaacttccacaaaattgaggatatgtttttaacagatggcatccaccaagaaatcatcgaggtcaacgaattcttccttgtcaaagaaattccccgacaacatagaatttggcaaacttaacggcacgtcaatttcgaacccaaaagcgtcaacgtcaccgtaacccaaactatcaaacggcgataactcttcgtatgggagaacagacgtcggtgatgacatatcgtgaacaccacttaacggcgactcacatgactcgcgctgaccatcaacaaccttagccttctccgttaaaacagcgtcagacggtgtcaaatctacgtaacggaggactaatgcgggtgatgccataacgttagcagtacccctgatagacggcgactcccgtgattcacacttcacatcacttgaaccggagttaacgtgagctttctccgttataacggagttcgtaggaaagttggtaacggcgtcgggtccttttagtttcagtgcagctcgatcatatactgtagcagcttcctctgcagtgtcaaaagtgccgagccagacccgtttccgtcgagtcgggtcacggatctcggcggaccacttccccagggtctctgacggacacccctgaactttttctgacgagatacatcaggtaacggta

SEQ ID NO: 10486 - DNA, 912 bp, Populus trichocarpa
  Predicted polypeptide sequence is orthologous to G1421, G1750, G440
gattctctctcaccctctcccctctccctcacacgcagagagagtgaagaacactgaactcgcagcaagacgttattctttttctcgtttcccactaaaagcttcacacccttttcgccgtttcaggctagccaacttcttcgtgaaatccaggagttgctgctccacaaagctagctctagctttaccttccctctttcgttactgtatttataagtacaccttccaactctcaagatccaattaatcttagtacatattaagtggcttccttcactcttcttcagtttttttcttcatctttcacttcattcatcagccagacaaagctggctagctagaccaacttgagctggtcaatacatggttttgcctctacgtcttcacccacttcttgatcacaaaacccagccctttctaccactctttcatcttctatcccccactaaatcataacccatgctgatctacaaccccaacaccatgtccgtacaatcaaaagtcaaatttactgaacacgtattcgccactaaaaagctcatcaagaaccagcagcagcagcatccttcttcaaggatccgcggccaaagacttgttagaatcatccataccgaccctgatgccactgattcctccagcgacgaaggagaagaacaagaacaggagaggaggtttgtcaggagagtgaagagacaagtgagtgaaataagattgctagagcaggagacaacagcaccagcagctccttcttcaagaacttcaaatgatgatcatcgagacccaacaagaaagagacctttcttcagactaccggtatccgacgtcactcgccggaaaaacttcaggggtgtccgtcagagaccctggggaaagtgggctgccgagatccgtgacccgacccgacggaaacgg

SEQ ID NO: 10487 - DNA, 798 bp, Populus trichocarpa
  Predicted polypeptide sequence is orthologous to G1421, G1750, G440
gcactcacacacacacacccccccagagtgagtgaagatcactgaactgcagcaagacacaagtctttttctagtttcccgccaaaagcttaccacccttaatttgcagcttcaggctatctaacttcttgatcaaacccggagttgctggtgtcactttgtcaccttcttccaactcctcgaagtgcaagctatagcttctctttttgtctctatagttgtcactagctacttatataatccctccaacgctggagatccagttaagcttagtataaagtagcttccttcagtttttttcctccaagaaaccaataagaatcttcatccttgatcacccaaataaattaagctagctagaccctacctgagctggtcagtacatggttttgccgctatgtcttgacccacttcttaattgaatacaaaaaccaacccttggtaccacccaccatgcatcttctattccccaatgaattacaacccatgtttacctccaacgccaccatgtccgttcaaccaaaagtcaaatttactgaacatgtattcatcactagtaagctcatcgagaaccagcagctgcatccttcttcaagaacccgccaaagacttgttagaatcatccataccgaccctgatgccactgattcctccagcgatgaagaagaggaagaacaagagaggaagtatgtcaagagagtgaagagacaagtgagtgaaataagcttgttagagcaagaaacaacagcaccagcagctccttcttccacaacttcaaatgatgatcaggaaaccaga

SEQ ID NO: 10488 - DNA, 906 bp, Populus trichocarpa
  Predicted polypeptide sequence is orthologous to G1435
ttttttttttttttttttcgaaataagctctttcagattaagggtcatgacaatggaagtattaagtagtcatgaaagagcctgaatttttttattttttttgttaaagtgatgctaacatgcacatggaccatcaatatacgactgtcactcccccggttataacaagtattatcagccaaggggtttgtggatgcacgaactgtaagcataatgttttgtcattatcatcttaaggaagtctttgtgcaggcttgatagtggaagacattggagaggatggatgcactaacctcttttttctcttcctctatagcatgccaaaaaaatatctcctcccaacatcacatgttgtcattaggtgcaacttgatgtggatgatgcgtgtatgaaccataatgattcccattccaatccctctgctgaaacatatgaccatgaacaacatttccattatacccgttttgatgaccattaatactaacttggtgatgctggtggttatcactactattattattttgaccgttgttattccccatttgcatccccatatgtccatatactggcattggcatcatcccacccgccgtggcagggtgatgataaggcatcggaattgggattccaaaattcccatttccgccgccgccgccatcactactctcgggaaaactctgcggcaaaggagtggacgcaaacaactgatcagaagcagaaggtccttcactcgacaacccctgcatcctcttcaaataaagccggtacttctgcaaatgactggctacattctcgcgagtcaaaccttcaacattcatcaactgcataatcgttttcggaaccgcgtttttaatccctaagtggctgaccacgtcaacaaacctcttatgcaactgaggggtccac

SEQ ID NO: 10489 - DNA, 937 bp, Populus trichocarpa
  Predicted polypeptide sequence is orthologous to G1451
ttttttttttttttttcagagaatagagatttactttctcaaaactttatctggtaacaaacaaaccactaccatgctgcattctcctaacacttccatgacgttactagtatagtgataagagaaacagtctcctatagtaaattacaatttacagtaacatgctagataacctgaccatgcacgacactttacccaccagaaaaaggttcaagtaacattaacgttcggtggatataacaggtaccataatatagttacttgcttttcagttaattgtcatgtgatttcaggttttttatgtgcatctgccttagtagtcaagagaccccatagatgcaatcccattgcttgagtttctaaaaccctgcgtattcatgtgcccatcgctgttgctattagaaagcttttggcatgggacagaagctgcaggactgagaccttctttgcccatttgttgcacttcaagaggagataggatcttgatataccagacattgttcacaaattcctgccaaggatcatcaccaaggagaagcacatcgttctcccggtcaccaaatacaagctgccagcctgatctctgtgggtcctctaataggccttctaggcaaaacaagcgagcaagctcactgcgaagctcatcatagctgctgaacttggaaatatctagtgatcgcccgtaggaccctgacttgtgaaccttcacaaaggttcttgttgatgggtttacttgatccacattttcagaggactgtaagaaacctgattcatctacacaacttgaagctgtcatgtctgaattaagtggaatatcacttccagtagcacttgtaaaagttgaagcagcaaatggcatagacaacggatcattttcagtgccaatatttctcaggtttggtatcccatgctgaagcatgaaggttgaagaatcaat

SEQ ID NO: 10490 - DNA, 775 bp, Populus trichocarpa
  Predicted polypeptide sequence is orthologous to G1451
ttttttttttttttttttatttcatttcatgaatggcatgattgctcgtacaagtttacatacctagaaccattctgccagattctaattctttaggctcactaatgaacttacaagtatctaatccatgatagaagtcaattcttcagaataactagctagtctaagcaaaatatgtaggagtactatataatataacttgagacatgcaaagaaacagggagaggtgcacacgttggagatgggatctcgtgtaagttcatctttaactccagggtgtgaggatttaacgaactacgtggaaggaagaatgccaaatggtttacatcactaagtttcggcgagccagtggccagttcttaagccacgctgccactcatcctttgacagcatttgggccagaggattcaaaaccctgctctcccatttttaaaacgtcctccggagaaagtatctttatataccaaacattgttcacaaataactcccagggatcatctccaaggagaagtacatcattctccctgtcgacaaatacaagctgccagcctgatctatgagggttttccaatttcccctcaattccaaacatctgagccagttcttctcgcagctcatgatagctgctgaaccgggatatgtccaatgagcgcccaaccgatcctgatttgtagaccttgacaaatgttcgacttggggttggtgggtccatctgtcctgcatttggcaataactcagaagagtcttgcacacaaccatacagagaattctggaa

SEQ ID NO: 10491 - DNA, 831 bp, Populus trichocarpa
  Predicted polypeptide sequence is orthologous to G1451
ttttttttttttttttttggtcccttataagcaactgttggcattcaaatttcaatagcttactaacgaggaacattatcttctagttacaataatagcttagaaacgaggaacattatcttctagttacaataatagctttagaaactaggagcagtatcttctaatcacattacaacaatagcttacattaaaacttaagctagattaggctttgcccctttcacttctgaaactgaaagatttggaaggaatgctaatattacagaagagattgtggtatcttaactgcttaaatttctcggcagtccaaagaccccacagaagttatagcattgctcaaattttgtgaatcctgccggtttacatagtcatcacagctgccattggaaagcctctgaattgggacactgttcagaagctctaaacctcgtttgcccatttgttgtacttcttgcggtgagagtattttgatgcaccacacgctgtttacaaattccggccaggggccatcaccaaggagaagaacatcattctcccggtcgatgaatacaagctgccagcctgatctcagggggtcctccagttggccttcaaggccaaacatgaatgcaagctcacttcgcaactcattgtagttgctgaatttggttatatccagtgacctaccaaaggaccctgacttgtaaaccttaacaaaggttctagatggtggatttccttggcccacattttccatggactggaggaaacctgattcatcaatgcaacttgaaggtgccattgctggattaagagagaaattggtgcctgcaatactcatgtaattag

SEQ ID NO: 10492 - DNA, 827 bp, Populus trichocarpa
  Predicted polypeptide sequence is orthologous to G1478
ttttttttttttttttttgttagataaacattttctgatataacttaatttctttatgaggattacatggagaacaatttcagggatcctctattttttctatttttttttctgatcacccatttatcctgtctgtgtctccctcctctttccaggaataaagctgctgtggtctctgaatttggatatgctgcaaataacagaagtgaccaacttaaacttacttgtaatcattctcatacgcatccaaaaccatccaagtgacaattttgtgctccctttcaataaatctcaagaaacaaaaacccttgacccaacaccagaaaacgaaagaagaagaagaagaagaaagggacagaaaaggtgaaggaaagaacaaaaatcaaagaaacgaaaagggctttttaagtgatccagagcacttcttttcaagattagaattacgatcccttctttctctccaactcacaatagttgaaagcatcacctcagttgaagccccaatgagacatctctgtgtaagattttggcatgtgttgcataacatgtttctaacatgcctgagggctaagaaattagctccatgcacccatccgtcacatttttgacatagaaatgcatgatctgcttgacaatacaatgttgccctcgagccacatagctcacaacaaacgaatcttgaggttgcattaggtgaaacagcctccttgttacaagaactgccttggttacttctctcctgattacctctacacatttctgggagctctctcagtatggaatggagagaaagaaggattgaaagaggggcgtctatatagcaacgc

SEQ ID NO: 10493 - DNA, 825 bp, Populus trichocarpa
  Predicted polypeptide sequence is orthologous to G1478
ttttttttttttttttttagcactacaccagaaaaacattactttggacaaaaaagaggtgataaaattagaaaatttccagagaaaaaaaaatacattttctgatttaatttgatctctttcagaggatttcatggagacaatgattccagggtatcctctatttcatcacccatttttctgtctgtgtttttctcctctcttccttttccaggattccaagcagctgctatggtctctgtattttcttggatatatatggtggtgcatataacagaaaaattgactgatcaattttatcacccacttgcaacaattctcatatgcacccaaaacccttcaagtgacagttttgtgttctctccatcaataaatctcaagaaaacaaatccttgaacagcaccagaaaactaaaaaaaaagggaagaaaaaaagggacagaaaaggtgaaaaagagaagcagaatcaaagaaacaaaaagggcattttaagtgatccagagctcttcttttcaagattagaattgcactgccttctttctctccaactcacaatagttggaagcaacacctcagttgaagcccctatgagatatctttgtgtaagattttggcatgtgttgcatagcatgcatctaacatgcctttgagccaggaaatttgctccatgcacccatttgtcacatttttgacataaaaatgcatcatctgcttgacaatataatgatgcccttgatccacacagctcacaacaaaccaatcttgaggttgccttagatgaaaccacctcttcgccacaagaaccgccttggttatttctctcctg

SEQ ID NO: 10494 - DNA, 853 bp, Populus trichocarpa
  Predicted polypeptide sequence is orthologous to G148
ttttttttttttttttttagaataaatactgcaatgtcattaattacttgagctaattaaacacgttcatgttcatcaaacatcaacaattttggaacacatcttggaacccattaatatctcatatatcatacacacacttgaaggacttataatacttcacgagagccatcttggagtagggttgctctttcctggaatgttagtcctggcatcaaaggcttgttcttggtaaacaaattgatggtgccccatctgtaaagtgggtagaggttcagaatgcttatatccatctgccttgctagggtctcgtacaccttgaatagctgggagacgcagaacaacttcctctagcttggtcttgagctgtttgttttcctcttcaagctcttgttcctttaggcgtaactcttccattttatcaaacatcagttgtgtcttcctttgcctagcttgtgaaagagttttgtcaagctgtttctcaatcttctccaactctttaaatgcaagtggttcaagatcttctccaagaaaattcctttgagagcgttgaagagtctcacattttgcccttaacctggagacctcttggtataagttatgtgacccttcctcagggatgttggtgtcttgtgtgctgtagcaacattgtcgatatcgctgaaggatactgttcatatcaatgctactaaactcaaaaagcttgccatggctagaaaagatgataagagcaacctcagcatcgcaaagaagcgagagttcataagcttttttgagcaaaccatttcttctcttggagaaagttacctgacgactgatcttgttctctatcctctccaaaaccacctttccc

SEQ ID NO: 10495 - DNA, 873 bp, Populus trichocarpa
  Predicted polypeptide sequence is orthologous to G1480
ttttttttttttttttttaaaagataatggagttacataaggaaaagaggtaaatggggcttttgacctgaaaagcaaaatttcaagagcaaaagccttagctgcaacatgattaatattgttgcctataaaacgaagggctgcacttcaactgatccgttcaaggattcgtctaagatttacagattactgtaatcaacgttaaaagagggtaagaccaccttaccgttattgattatagctgacaaattacataatcttctagatagtaattaactggctagttaacctctcgctaaatccatgatcaaaacgagggaacgacaccgtattgggtatcggccatgaaagggacagagctcggagagttatataggttgtccatatcggattccatttcggttcgttttgcgaatcggcctttgattctcggtctggtttcagcgtaagcttttcgggaagcataccgtatggtcttttcgaactttcggttcttccttctctctctgtacctcaaaactctagcttcacggtcaatcccagctaattgagttgctgcttgattcgcagtccagcctgagaggggcatgcttggatcggtagtagtattcatgcttcggctgaaaggataggatatgtcggacatagaattcccatcaggaacaacaccaacatctagggaagacgaagaaacgctgtggctaagagactgagatgagtagctgaaagaagtgagtttagatctacagaaatcaatgtcaaagcaactttcatgattgatcaccggaagcggagctggtttggtttgcacaggcacaacgctatcagcaccagcaccagcaccaccatgaatcttctcatagctcgcatcaa

SEQ ID NO: 10496 - DNA, 854 bp, Populus trichocarpa
  Predicted polypeptide sequence is orthologous to G1480
ttttttttttttttttttactttagatagaaatccattctacttatatacaacaccactggtgggcaacaaagattacaacatcaatctcctatacaaaaggagatacaaaaaagacttcgaattattgttacaacaaggagggagtgatcaccaatgagcttgaagctcatcggaactcgccagtcttcttgctaagcaagaggagtgaggtcgacgaattcgaattagggaaagacaagtgaatttagaacgatggaacgacaccgaatccataaagactgcttcgatcaacctcgacttcagtatctgtacgtttagcgaaccttcctttgattcgtggccttgtttcggcataggcttttcttgatgcgtatcgaattgtcttctcgaattttctgttcttcctcttctctctgtacctcaacacccttgcttcacggtcaactgccgatagttgcactgtctggtttgctgactccattccgttgcacactgatctactacagtatgggttagatatgtctgtcaaggtacttccacttccatctggtaccactccaacatcaagagatgaagaagaaacactctggctcaaggagttatagccatagccaccaccaaaagacttagatccagtagagaaatccaactcatagcagcaatgatcattgaccaaagcaggagcttgaaatcctagtttgttactttgcacaggcaccaccccctcagtagtccctgaactgttctgctcttgcacttccacttttggatccacatacggatccaaatccaaatacggatccatttccgaaccaaacacatactgaccggtattcagatccatactatcca

SEQ ID NO: 10497 - DNA, 826 bp, Populus trichocarpa
  Predicted polypeptide sequence is orthologous to G1480
ttttttttttttttttttggagaccaagaccaaaaactttttactaacggagaaggaattacagaagccctgatagttaaaaagagaaggcaaatgggacttttgatctgaaaagcaaatttcaagagcaaaagcatagcagcagcgtcactaatctagctgcttagaaaacaaaaggctacacttcaactgatccatttaaggattcgtctaaactttacagatgacggtaatcaacgtcgggggggtgtaagaccaacttcttaccgttattatagctgacaaattacatattcttcttcatagtaattaatagctaattatcccctccctaatccacaatcaaatcaaaacgagggaacgacaccgtaatgagtatcggccaggaaagggacagagctcggagagttatatagggtgtccatatcggattccatttcggttcgcttcgcgaatcggcctttgattcttggcctggtttctgcgtaagctttacgtgaagcataccgtatggttttttcgaatttacggttctttcttttctctctgtacctcaaaactctagcttcgcggtcaatcccagctaactgagctgctgcttgatttgtagtggaacctgagatgggcatgcttggatcggtataagtattcatgcttcggccgaagggatacgaaatatcggacatagaattcccatcaggaacaacaccaacatcgagggaagacgaagaaacctgaaaaatcaaagaaactttttcagcaactctactaggcttatagttatttgagcttcaactacgcaggttttcgtacttacgctgtggct

SEQ ID NO: 10498 - DNA, 939 bp, Populus trichocarpa
  Predicted polypeptide sequence is orthologous to G1488
ttttttttttttttttttaacataaaggaattcactgcattactagctaataatttgattcagcatctatgggactatacttttctagtatacattggaaaatggaatttcggagttactgctactactggtaactaggtattaaagccagccattctcatctccattaccttcttgtgagaattcgagtgtaaatagctcacaaaagtaggactctttgctggcctatactctggcaatagcctgcctgacttgtatctcactccacatgcattacaaagtgtttttggacccagtggtcctgccctccattgtggggtcctttgtgctaggcaatgggtgcacctccttggttgctgctgtccattgttgctttccaaaacgcctaaactgtccttgctaccattactccctactacagctactacctttcctatgtcctcgtcgtgcactcccactcctgattcttcttgcacttcattatccatgtctgtgttgttgctgtcctcttttatgggcataatgagttcactgtcagctagccaatatgtttgctgaagcaaaggagggtctgagctggtcaaattattaaaggcttggttggtataacaccagctagttaatgggtttctggtcttgtcaccaggaagccttctcctcttgcttcttgactttcctgggattacaagtttcttcaaggaagatgggtcttcttggtcttggggtttccgttgccagttttttggggggttttcttctgtatttggcttttgagcttcaactgtgggtgctgggaggtagtttcctgtgctggacaagcagtcctctacaaatactgacagccattccgagctaaaatcaacttccgtgttttgagcagagaaagggtcatcaagaggactagtagtagctgtcaaagcagcagcagcagcacaagtt

SEQ ID NO: 10499 - DNA, 939 bp, Populus trichocarpa
  Predicted polypeptide sequence is orthologous to G1494, G789
ggttaaaaacagaccctcctctatctctctctctcgggctagtccattctcaaatttctctttacacagctttctacagagagagagagagagagaggtcatagtggaagttgaattggttcagttgaattggtttggtcagtccagaagaatgtctttttttgccccttttatcttcttctctttcgactttccttttcttgacacaactatttgtgggtcttcgagtttctgtagtccttcttcaaaagactgcacctttgttttcttgaggattctccaatgggtcttgttttcaaaagtttccctctttgactggtgccgattttgtcttcttctttttcaagcagggtgcttcgtgttgctgattctttctttcagtctgtctttatgatatgcatacagttcttgatactatttaattccatttcatgtttatttattattaatttacctgttggtgtgttacatggtttctcctcgtgtttttttttcttttttctttgaccattttataagacttagataatgacacagagcatcatacccgttagactgataataattattaatactttttgtcaaatattttaaacttatcttctgtgttgtgtttaacaggatatctgtgtcttctcagccatgaatcattgcattcctgattggaatcttgagggtgatcttcctgtctccaatcagaagaaccccatagagccagacaatgagctagtagagctgctatggcgaaatgggcaggtggttatgcacagccaaacacaaagaaaaccaaatcctcacgttcaaaaacatgattcaccaacagtaaggggctatgactcaactctgaattcaagtcatttgattcaagatgatgagacagtttcttggattcatgaccctcttgaagattcctttgaaaaggagttctgttccattttt

SEQ ID NO: 10500 - DNA, 772 bp, Populus trichocarpa
  Predicted polypeptide sequence is orthologous to G15
ttttttttttttttttttgctaaagaggaataaaaagtatttcctagcctaaaatgcttgattaaagactaaatttttagaagtgaccgtagtcctttaatactaagctgtggatattgtaatgtgctaaaagtgtttgattaaaacaaatttcaggtacccaagaggaagctgctgaagcttatgatattgctgcgatcaaatttcgtggggttaatgccgtgactaactttaacataacaagatatgatgttgataggatcatggccagcaacactcttctagcaggagagctagccaggagaaaccgagatacggaatctagcattgaggccattgattataactcatcaacacacgacaatggtgttctataccagtcatcgcaggaaccgccaaatgcctgtggagaatcacttgatcagaagtcgatgagttctggaaattatcgaagttcttctttctcagtggcattgcaagatcttattggtatcgatcattcagtgaactctagccagctagtggtagatgaatcagccaagctagggactcttctctctaacccctcatcgttggtgaccagtttgagcagttctagagaacctagccccgataagactgccaccactatgctcttcgctaaacctccactggcatcaaagttcgttagccctacaactagcgtcactccttggttccaagctgcccaattgcggccagcggcaatccccatgtctcacttgccagtttttgctgcatggaatgatacctg

SEQ ID NO: 10501 - DNA, 761 bp, Populus trichocarpa
  Predicted polypeptide sequence is orthologous to G15
ttttttttttttttttttctttatataagaagggccagccacttcctactatattgccaacatcatttcacagcacagaatttaatcatgagactactacttctctatcccttttctctccattttgcaaaatgttcattccaatatcgagcccaaaaggtcaatttgacaaaggttcttacacttgggttacagacaaattactggcccccacccttgtctttcattaatccccggtttcctccactaacctcctaaaaagaaaaaaacatcatgaaaattcctgccttcacccctccttttccctccttaaacagtaactcttccttttccttagttcatgcaaaaactccacatgggaaccgctaacacaaggctttaggtatcattccatgcagcaaaaactggcaagtgagccatggagattcctgctggcctcaattgggctgctgcttggatccaaggagtaacgctggttgtagggcctatgaactttgatgcccgtggaggtttagcaaagagcacaggggttccggtcttgtcagggctagcttctctagagctgctcaaactggtcaccaaagatgaggggttcgagagatgagttcctcctagcttggctgattcatctaccactggctggctagagttcactgaatgatctatacccataagatcttgcactgccactgagaaagaggtgcttcgataattcccagcactcattgacttctgattaagagattctcactggcatttgg

SEQ ID NO: 10502 - DNA, 541 bp, Populus trichocarpa
  Predicted polypeptide sequence is orthologous to G15
ttttttttttttttttttcgaagcaaaagagagaaccatacatactctatttgttttgttctgtacttgagagaggcaataaagctgagtctaattatgaaaatggtcatcccatattgcacaaatcattccatagactccaatcatattgtttttaaaagcttccctccaccattaaggtcaagaaaaggaagagtttgaatatttgaagctcttgttcatgaacaaaggtcccatgcacccaagtgtcgtttaatttaactaaaagaaaacccaaataaaaaccaatctctttctttggaaacctgtttgcaaaaaaaacctttgcatcgaagtcctacgcatctgtccaagcagcaaatactggggcgtgaggcaaggatactgcaggcctcaattgggctgctgctgctgatgggatccaagagctgacatcaccatttggactagtgaacaacttggatgctgctgagggcggcattccgaagagcattggcaggcttgctctatcagggcttccttctctagagctacttaaacc

SEQ ID NO: 10503 - DNA, 695 bp, Populus trichocarpa
  Predicted polypeptide sequence is orthologous to G1506
gagatgttgttgcaatgagtaatatagctggtgccaaaagatcacgtgacagccctagtcagaagttttcagaagtgaagttaatgaagagccccaaaaggattatcatgaaggctacgtatgagaacaaagaactcatagacaatgatggatcttgctttagtccaagaagcctatttgccctgcctactgatggtagctccctcatgctggattctctccattttgtggatgaaagttctgatcaggacctgctgctggacatcccatccaatggttcatttgcacaggcagagctcttttacccaactaatagttttggtcaacaggcaagcactagtagtagctcaatatacccgcacctaggccgcccctaacaaagtttgtccagttgattcttttaatcactagggccaaaaatagatgcaccttccgctgaatcaggtgactaggttacacatgttttgcatgccaaacccaacaagtctgtgaatgaggtttgatggttgctgttttttccttggatcattttgaacttggtatgctaagagatgacttttgggtgggtttttgtataggttgactacagattgttatatatggctgaaaagtgatagcagctggtgatttcaagagttttatatgcaattatagttgctgtattgcacattactttgaaaaaaaaaaaaaaaaaa

SEQ ID NO: 10504 - DNA, 767 bp, Populus trichocarpa
  Predicted polypeptide sequence is orthologous to G1535
ttttttttttttttttttggagaaaaacagttcattcagtggcattaaattcgaaacagcataaaatttagaccggcaagcaggagtcaatacccgaaccaccacccttgctgactggtgaggccccatcttcataacaataatacactgagaaaggccttaccaggaagcaaaggtcacatcttggtgcgctcttgactcccctctattatccctctatttttttaattttacacagcccaatatctctgccatttatggcacaaccatcctctcatctcccataaaatctaccccactgaccgaattagcttcgcagtctcttgtttaccgaactaccactacttctactagcattacagtaatggtaacttatttgcaatcctagcctttactaattacctgaaatctcccctctgcaaacccaatagaaagggattagcaaaaaatgatcccttagtcctctttgtgaaatgtccaatgttgtaaccaccaaaatgcacaaggagtttctctgggagagagagatagaagaggggagactcaaggtaatttgcacggcgaaaaccctaaacttgttgtttgggtgcagctgtaggctcattgcaagaccctacagcattgccgttatcaaggcagctgctagtggtggtgttgttgttgctaagagcaacagtgatttggttcactgtgttgcacaaatggttgtttatcgcagtgacactggagaaattgagctttgcagatggaatagtgcttgcaagggc

SEQ ID NO: 10505 - DNA, 860 bp, Populus trichocarpa
  Predicted polypeptide sequence is orthologous to G1538
ttttttttttttttttttgctagtcaaaaggcaaagcattaaattaatatcggcatgcatttccaattactagctagcttgacagagagacctcgtgatacactagatgaagaagatgtttacattagattgttacttaatcactatctacattatcctaattatagtaatatcagttagctagccagttacatatacagattaatccattccatgccaggaatgtaattgttttctggtggcatgtagaaagcagcatcttcatatccttccattgcaaactctccaagaaatggggggtccatagccatcgacaaggatgaactaggactattagtggaaaccccatcaatacggtctgacagcctttggatctccttttctgcttcagagagttgttccttgagctttaaaacctcggattcaagctggcatttctcgacaactatgttttcatgggatgtcttcaactttgtgtactcctcctctagcttcttgttcttccaccttgccctccggttttgaaaccaaacggcaacttggcgaggatcgagtcccaactctgaagcaagcttgtctttcctctcagattccaacttatgttcattaccaaaattcatttcaaggagattaacttgctcctcattaagtttcctcttccttgccccactaagatcggcgtctttgttcttctttcgccttcgtcgtggtttagattcaccttgttgtggaaccatttgagtgaatacacctgggtacaattgagaggtgagtgccatgtgatcttcaagcttggtactcatggcagttgtcttcctattggttctcacgctccctctctctctcttttcttttctttt

SEQ ID NO: 10506 - DNA, 905 bp, Populus trichocarpa
  Predicted polypeptide sequence is orthologous to G154, G1797
ttttttttttttttttttgcaacttgaaaacttataggatatatgggtacaagttgatctacgaactcatagcactctctgttcactttgttagtaatgaagtgaaactgctaaagtgttttattccttaggcatggtacccaaatctgatcaacaggaaagcctacagtcataatattatctctacaagtataccaaaacactcaaccctgacttgggcgcctagaccgttatctgcacaattcagatttatttgaggtccatatgcacgagaagtagagtttataatacggattttcactaactctatatgcctctatatcgtacacaaaaacttcaaatcccagagagaaaaataattagaaaggaaaaggtatgagaaaaggaatcactaggatcgtagaagaggataacaagagaatcccaaagtcctgcaaggatcaaggtctgtgctactatgtgtacacgtgtctgacttgtttgtttctgagagagaggcacactaatgagatcttgcatatagaaccctagggtgcaggaaccataccagcatggtacatgaaagtgaaaaggaaaaacaatgcaggaactcaaaagctttcatggaaagaggagggtggtttgataaaaaaagaagaagagagtgatacatgaattaactctacatatatatatgtataaaccatggaaggaaagctgtgcaaaagatgataccttgagcttccaaattcatagagcttccctctaggagagaagacgataacagcgacctcagcatcacaaagaactgatagttcaaaagccttcttcagcagtccatttctccgcttagagaaggtgacttgcctgcttgtagcgttctctatgcgcctcatttgagtctttcctctcaccattttctctta

SEQ ID NO: 10507 - DNA, 764 bp, Populus trichocarpa
  Predicted polypeptide sequence is orthologous to G154, G1797
ttttttttttttttttttatccccttttttttttaggcttctctttgactttctcatatgatggttcaaacaagtttaatagcatggtagagaatcaatatatatatatatatatatatatatatatatatatataatcttccaacagatattttaactcatcgcacaatggtatagttcaactccctttttgttatgtaatatatttgggagagtttatttgactcgcgacattagctatcagatgcaaatgatttgaaaaaaagaaaaaaccattgacacttgggaagctggaactgtattgcaaatttgaaactgcaattattcaagtcttatggttttggggcaagccgtgtctctggtggtcctataaacaattctgtctccacctccgtaatttgtcggtcttctaatagttgttgcttcctggttgatgagaggtcaggttgttgcatcccacacttctcccgtaacctcgtgttttcttccaacaggattttctcctcgcctttgagcttctcaatccgctccctaaataactggttctttcttgccctaattcttgttaagcttcgccccaactggttctccaactgttgtaggtcatcagtggaacatgtttccaatccctctcctaagagcttccttttagagacttcaagaagctcgatcttcttggccagagtaaatgtatcttccttcacaggctgtatattgtcttgaaccatcttgctgctgattcctacgtccttggctctcttctg

SEQ ID NO: 10508 - DNA, 486 bp, Populus trichocarpa
  Predicted polypeptide sequence is orthologous to G154
ggtttcaggagaagctactggcagctgaaaatgcaagactgtctgacgagtgtggtgcacagtcatggccagtctcaagggaacagagagatttaccccgtgaagatctgagagaaagcagttcaatttcggatgtggagacggaattgttcattggaccaccagaaacaagaacaaagcgcatccctccaagaaactagtggtgaatgccatcttactgcgagaccaaccttttcatattcttaagactcttgctaatgctatgttgcacctgcgcaagcaataattaaggcaatagtattattttaagagaaatatatatgctgtctgttaaaaaagctaccatgattgattgagatcaactgtaaacagagtacttaaatattgtaattaggtatatatttgacgtatcgttagacttttccttgtatgtttttctgacaataattttcttaaaattattctgtcaaaaaaaaaaaaaaaaaa

SEQ ID NO: 10509 - DNA, 876 bp, Populus trichocarpa
  Predicted polypeptide sequence is orthologous to G154, G1797
ttttttttttttttttttggcacagagaaagtctaatgatatgcaataaatatatgtatcagtttacaattttagttaatctccttcatggtaggctggtagcttttttaacagacagcatataaattgctcttagaataataatattgccgtggttgttgcttgcgcaaatgcaatacagttaaagtctaagaatatttatgaatatgagaaggttggtctcacaataagagatggcgttcaccactagtttcttagagggaggcgccttgttcttgtttctggtagtccaatgaacaattcggtctccacatccgaaattgaactgctatctctctgttcttcacagggtaaattctctctctgttcccttgagagtactcgccatggctggacgccagacttgttagacagccttgcattttcagctgtcagttgcttctccttttgttttagttgctcaatctgttctctgaaaacctgattctttctagctcggatggtgcttacactcctctctaactgttgttcgatttgttgcagttcttcaacagtgcacgatcccaaacattctcccagtagctttctgaagcattttaaaattaattttcaaacatttacgtataatatttaattccaacagtcaatcaattcatcaaactatactataagcacaaaaggtttaaactaatcctttgaaccgtttcgaaacttcaagaatctctatcttctttatcatgctagctgcttcgcccttcagttgctccatgttcagttcgcttgtctgcttgtttgtgttgctttctttcacatgcctctgataacgttcaattgtctcctgcacgcttgagcttccaattcatagagcttccctct

SEQ ID NO: 10510 - DNA, 911 bp, Populus trichocarpa
  Predicted polypeptide sequence is orthologous to G1634
ttttttttttttttttttagctttgaaggaagcactgccatccagattcgattgaacctaaaccaaattcgcttttccatccacctatacaacaaagaaaggtgccctaatattgaatttgaaatcttgggggtggcaatttaaaaaccatgttatgggggttgatacgagccccatgatgagcaccgacacacagattttgcccctgaaattttagaccgttcgaacgtatctcatatggagatgacttaaacaagtcttcatgagttgaatcaaagaccataatcgatccatcctttgcttcgtcccagtcaatcaacactttctgcatccctgctggcttttgctgcgataaaagcaaatcagattgatctagcgaggaaggttcgtcaccatctgacggagtagtagcatctgcgagattgacagttgtaatgtcatggatgctaggtcttctcttatccttcactccggaaagctgctgccgtatgaaatacttctgtgcatggctcgccacttgagttggagtcttggaaactacaaaattgcgagagatgttcctccagtccccttttccatgctttagaagccccataaggaaccgcctgtgctcatcttctgtccatggcacacctttctttctctgctgatcagcactcttggcagtcaaagacctcttcctatacgcatcaaaattgctattgccaaccaactggaaagtgaaagacgagctaaggtaacccggaaccggaaccctccctgcttctatatcactaacatcctcttccagctccttgtattgcttgatcacatcataaactgtctttccaggtatcatagctgccacctttagccacctatcaggctcatgctcatcaaatatcgccaaagctatctcaaactccttgttc

SEQ ID NO: 10511 - DNA, 647 bp, Populus trichocarpa
  Predicted polypeptide sequence is orthologous to G1635
ttttttttttttttttttggtctggcctttagtagtttcattggttcctctgagctagtgttgctgcctttttattcacgcgcaaccttaaagaagaatttctgagcatggcttcgaatctgaactgcattctttgtgcctaaatgctcttcaatccgtctccaagcacggccgtaaagctttagagcatcaaggaacttcttatgctcttcctctgtccatctctctctttgtttcgtaattgtgtaaggtttcctcgccttgggagagtaatcactcccacaagagaactgctcctttagttggtggtcagttgccttctgtagtgtagcactcggtaaaattccattgcctgctgggagaaccagatttgatcgagtccctccacactgatcctgaatagccatatctgaaaaaaccactcaaaatacccttcttaaagaaactcttacagtacccttcttgatgatatcttcctcaaactcataaactaacataataacaccaaaaaatatatctctccactttcacttattctctgacacaaactaaaaacgcaacctgacccttcaaagcaatgaagtcaaagcttaatattctaacaaaaacctaaaaagattgaagcttttggcttctaccaagctaaa

SEQ ID NO: 10512 - DNA, 819 bp, Populus trichocarpa
  Predicted polypeptide sequence is orthologous to G1646, G715
ttttttttttttttttcaattcaaatggtagcatatgacgcaatagaaccattcgaatcagtaacaaatagatcataaattaataaactgcacatcagataaagttagcaagttatagcagcaattgtagagctgccatacactgaagttaaaaatcttaagaagtctctacagctacggacaactttccagaaaacaatagcaagcaagcacatttagatatcatatgcactcaaatttcccagtaatattagccaaggcccttgttagcctctgtcgcacctctgcatccgagaagcttaatcttgtccatcaagattcccttgtccaccactcgcaccaccactcccataagaaccatcttcggtggcagctgtctgccaaacagactgccaagcctgagaaggtggttgaacatacaccccagtggcaggatccatggctggccttccgatcatcatccctccagtggcagcggcaggctgtcccatcggagggtaataatatggcaccccactagccgtagcaccgacaattccaccaagaccagcagcttcctctttgatctcatctctaggtacaatatcaaccaagaaatcaaaaatgtcagttcttgtaatagcagcagcaatgtcattcttctgtaaagtccttctcttgttttcctcagcgtgaagccaagaacgaattgtcagttctaaaatgaaaagctcacatgctttagcaaagagaataggtgcttcagcagagatcatgcgcacatcctcgtcagctttcatgattttcttgattcttgctaaagggagttgatggttcttg

SEQ ID NO: 10513 - DNA, 975 bp, Populus trichocarpa
  Predicted polypeptide sequence is orthologous to G1646, G715
tcgagccctcgaaaacaaaacaaaacaaaactacttttgtctccgatcaacaaaacaatggacaacaccaacaccaacaccaatcaccagcctcaatccaccgcatacccgccacactccaccaccaccactccaccaccaccaccaccaggggcaccatcctcagccccattccaccacctccttcaacaacaacagcagcaacttcaaatgttttggtcttaccagcgtcaggaaattgaacaagttaatgatttcaagaaccatcaactccctctagcaagaatcaagaaaatcatgaaagctgatgaagatgtgcgcatgatctctgctgaagcacctattttgtttgctaaagcatgtgagcttttcattttagaactgacaattcgttcttggcttcatgctgaggaaaacaagagaaggactttacagaagaatgacattgctgctgctattaccagaactgacatttttgatttcttggttgatattgtacctagagatgagatcaaagaggaagctgctggtcttggtggaattgtcggcgctacggctagtggggtaccttattattaccctccgatgggacagcctgccgctgccgctgccgctggagggatgatgattggaaggccagctgtggatcctgccactggggtttatgttcagccaccttctcaggcatggcaatctgtttggcagacagctgccgccgaggatggttcttatgggagtggtggtgccagtggtggacaaggttaagcttctcagatgcagtgattagtggcatgacagaaggcaaatatgtaccttgactaatattacttggaatttgaatgcatatgatctccaagtctacttgttggctattgttcaagaaagctctccttagctgttagagacttcttaaaacttattaacttcattgtatggcagctctacatttgctgctgacttgcctaattatatctg

SEQ ID NO: 10514 - DNA, 514 bp, Populus trichocarpa
  Predicted polypeptide sequence is orthologous to G1760
ttttttttttttttttttggcaaaaatatctctaaatgtttcatatcattgatcacagttgacgccacatccgccagaaaagaaaagctaccagactttctatgtatttatgaacagggtttttttttagcaccatattcatggacaaagtataagactctggcaccacacctaatacttgcctctgtgacattgcaggcaattgatgggagaagaactgtctggtttgagcgccaaggatctacagaatctagaaaaccagctggagatgagtttgaaaggagttcgaatgaaaaaggcaaagcctccctgatctcaagatcactttttatatgcacatgcagcatgcacataatgctgatgcagcctttttctttttacacaggaacaaattttaactgatgaaattaaagacctgaacagaaaggttttccaagactattgacttcaataattctcgaattgattgtaaagacattctcatgttcactggctttcatcggcttcattgcag

SEQ ID NO: 10515 - DNA, 882 bp, Populus trichocarpa
  Predicted polypeptide sequence is orthologous to G1760
ttttttttttttttttttcatacaagaaccaatctcaacatttcattaactcaaaaggatatacacaagtctgtctgtgcatgcgctatgcacaatgattttctattatgccaagccatgttcaatttaattttatcctgcaaccaaacacaatagtgacgtcgccatacaggaacatttacaaaattcataaacaaaattcctctgtgcaaaactgaatacacgaccatctcattaagtgttctctgtagactgtagcatgaacatgcagatttataaggcaatcacttcttcaagcagctctcatcaattctattctactccaaattattgcttgttatatgatgcacttcattttctgctcactagttgtggaaaagggaggcagcaagcttggggaaggaactgcagtgcttgaaagaatatcatcggtaaagttaattatcactgaatattctcaatagaggatctcaacaacacgtcaccgttggccttaaaataatggtgtaggctgtgtggttaaaaaaatttacagccatgttatgtttcacatcatcgatcgcggttgtagccacatctgccacgagaaaaactaatagatttatgcatccatggacaagttttctttctaacactatattcatggacaagtataaaactccggcaccatacctaacatttgccttgagatgttgcaggcaattgatgggagaagaactgtctggtttgagcatcaaagatctagaaaatctagaaaaccagctggagaagagtatgaaaggtgttcgaattaaaaaggtaaacctatactgatctcaagatcactttttgtacatgtatgcagcatgcacttgatgctaatgcagcctttttttgcacaca

SEQ ID NO: 10516 - DNA, 480 bp, Populus trichocarpa
  Predicted polypeptide sequence is orthologous to G1767
ttttttttttttttttttgaaatataatactacggatttctatatcatagctttgtacttggccaattttgaattagcagaggtactgcctccagagtcaaagggggccttccctatcacccacggacataaccatcttcggtccaaaagacagactcacacacttatttccttcccaccaacaaagcaatgatcaaatagaagctagctatagacatgcaaagcaatagcagcaacaacaacaacaatcagcctcagactagtcatacatcaacaagccgttcttcggactccggtgaggcttgtggggcaggaaacaaatgggcatcaaggcttcttagtgagtgtgcaagagcaatctcagagaaggactctagcaagatccataaccttctatggatgttaaatgagcttgcctctccttatggagattgtgaacagaaattggcatctcatttcttgcaagctctcttttgtaac

SEQ ID NO: 10517 - DNA, 514 bp, Populus trichocarpa
  Predicted polypeptide sequence is orthologous to G1789
gaatctcttcatggcttcaggttctagtaattggacttcaaagcaaaacaaactgttcgaaaatgccttggccatctatgatcaagaatctcctgatcgctggcacaatcttgccagggctgttggaaaaacagtggaggaagtgaagaagcattatcagatgcttgttgaagacgtccagcagattgaagctggtgaaatccctttgcccaactacactagaagatctggagctagcaacaagagctaccattgcaatgatgatcaagcacaaagggtgaagaatcttaatctcaactgaaggatacatgaactaagctagctatagaataaagatccattgcgctacaaatgacaataggcagaagcagcagcagtagcagcagtgttattagctagcaccgaaaatgggattacgatctctctttgttttatctgtttaattactttctcatcaaacattaattctcagttaatatctcttaatttcctgcttgcaaaaaaaaaaaaaaaa

SEQ ID NO: 10518 - DNA, 805 bp, Populus trichocarpa
  Predicted polypeptide sequence is orthologous to G1808
ttttttttttttttttttaacaataggaaaacaagatagataatatagctttaaataaccgaccgagcacgagtcaactactctttttacatgagaatgaaccaaggctcaccaaaaccgccaatcattttgccctaaaagcaccctttaccaaaaatcaccgtaaaccccaccatttaagttttgcttcatagcagctttatcatttacatatatatataagactctacaaggagtgctgatcagaagactctacaaataaagcctcgttttcttcctgttttaactttcagtttcatgatttattgagtttattttatagtttatgaagtgattaatgatggagctatttgttcggtggtggtggtggtaatcatattattgcatggccacgcggacgtcaattcttggagttgcctcatcatcaaaatttggcgtatgtccgacagcttttttcggagcgtactatactcagaccggagtcggtcgtagtctgtccgtacaccatgggaatggtacaaaacaaagcgcaaccggttcgtcagttcccggttctcaatcctaagccggttcacctggttccttaggttttctacgtgcttctgctttcgcatccgtgaccgccttgccgactcccggtttgataccatccgcctgcgtttcctctcatctatgagtgaagcttgagggtttgggtcgtcggagccagagtttgagttcgagttgtcagggttttggcctgcctggttggatttatccgaaccggaactcgaaccaacaggttttggtgactgaggagagcttg

SEQ ID NO: 10519 - DNA, 665 bp, Populus trichocarpa
  Predicted polypeptide sequence is orthologous to G1855
catattctcttaccttgacctatttccaactattctctatgacgataatatagtatgagaagaaacacgggggggtaaatttatcttcgttaacatggaggaaaagcctatccgttttctcatccacaaggatatatagtccttgacaaataatccgattcaacatgatggtcaccaaaaaagaaaggaaaagatagaaaggaaatgaaaaggggtttctggaagagtaagaaattacactactatggctactccttttgtttttgcttcttttcaccagtccagtaagttttgacagcaacaagaattttctctgggttaaaaggtccactttcatggtccataatttggctcttccacctcatgccatttgttatggtctgaatcctcacaagaacctctactgtatccctgaatatcactgtcccttctggcctcagaattctatccatctccagcagaatgtgggttatgtcacacctgtcctgatatatactaaacaccccaccaccatggatgagatcgtatgttcttggatatgttgagactgcctcacaccaatcttgatatgttccaatgaaacctcgttcatagatcacaccaagtgtgtctggatttgaattggcaggaaccacattcctaacccacactggatattttgccaa

SEQ ID NO: 10520 - DNA, 855 bp, Populus trichocarpa
  Predicted polypeptide sequence is orthologous to G1863
ttttttttttttttttttcagtaacgttaggggacagatttcacagaatgacagaggtaactggatctttcaatgctctcccgagcaatctgtggcaaaaggcaggcttttttttggtggtccagactttcttaagcataactgatgcctctgagcacgtcccagttaagcttgttcgctagtatcattgctagccaccagattcaggtgcttcaagacaaatcttccatttgacagccagtaggaaaacagaagcaaacttgaatttgtttggcagaagacacttttatatgcctatgtgaatatagcaacatcatccaatttacttccagcaaatgcagccagaaaggcagaaacaataataaccattcaaccaaagagcagacagcaaccgagactacatggagtacacggacttgaagccaaaacaagatcagaccatattgggacccgtggaagaaagcagcaatccaggacattcttaattgctggttaaggaaccaatctgtggcaaaaagaaggcttttaatgagcactattcctacagaatcagacactcaacaagcaagaaaagtgaaattatctgctgggatgcataattggagaaatattgagatatataggtgcttgtgacgaagctttgttgtgtggacacatttttttataagaaaactctagatgcatgtccataatacaagtttaaaatccattgtactcaaacaaagaaggcaggaaaacagttatcaacaagataatcaaaaagaaggggcggaaaagttatttcattcatcgactgaaaacataagttactcctgctacatgttggtctaacaaaagaaatggtctcccttcacc

SEQ ID NO: 10521 - DNA, 588 bp, Populus trichocarpa
  Predicted polypeptide sequence is orthologous to G189
gggaaatcaagaattaaaagggtggttagagttcctgcaattagtagtaagatggctgatatcccacctgatgattattcctggagaaagtatggccaaaagcccatcaaaggctctcctcatcccaggtatcctatagttgccttctttgtttccttggttctcaatacattctgggtattgtcggtccttcaatgttcctttcacgtttcgatttatacttggatagccgtgggcaagtccaaaaactcaaccttgattccttttgtttcaacttgtttaggggatactacaagtgcagtagcgtgagaggatgtccggcacgcaaacacgtggagagagctctagatgactcgatgatgcttattgtgacctatgaaggggaacacaaccactctcatccaatcgatgatgcacctggtgctcttgtccttgaatcatcttaagtcaactgatcaatcggcatggaaaagatcttccccagttcattcacgcccgtgcaagacaagacactagtgctcagatagtcaaaaggacaaggctagtgggcacattagctgcctaagcagcaaaaaaaaaaaaaaaaaa

SEQ ID NO: 10522 - DNA, 741 bp, Populus trichocarpa
  Predicted polypeptide sequence is orthologous to G189
ttttttttttttttttttcaatgtctacattaaaaatataattgaggcagacaagaaagtttagattcttgggcagataccagatgatacaagtaattttttctttttaaaaaaacaaatactgggcttctggagatatatagtgctgataatatttcgatttgttccacagaggttactacaagtgcagtagtgtgagaggatgtccagctcgcaagcatgtggagagagctttagatgatccatcaatgcttgtagttacctatgaaggagagcacagccacactatctctgttgcggagacatccaatctcatcctagaatcctcttaaccagatcatcgccatcaacaagaacgaaaaagtgtaacaaacagtacttcttctaaacagcagcggtagcggccaggagctgtggaatcagatgattagctcagctttttcttgaaagagattagagggtcagtccatttgttcatttgcatgtaaactatgggattcttgctgccttcttcttccccgctctagctagaacaactgtgaacccgtatgattttagttaaattgaaaatctaaaaaggaaaggattaaaagatggtggatttggtattagatctcaatcgatctaaaagaaagctaggtagctttgatttttttttttccatggcttgctttaagctctgggttcatgtttttggacgcctacttctcacttttcttgcatcaagctcgtagtttgatc

SEQ ID NO: 10523 - DNA, 589 bp, Populus trichocarpa
  Predicted polypeptide sequence is orthologous to G1944
tcgtctcgagaaaggtttttctcaggaaacaaacagttccttctctttcttttcttgttcttttgttctttagtgttttgctgagagaaaactcgaaagtgccggtactatttgaagaaactaagcgaatgtgaaagggaccgagagagagacgctacagtttctggagagtatcttcttaaagtctcgaagttgctgttaatctggaaaatagtattgttaggtgtagtgatttttgaataatttacagtttatgcatggagggaagagaaggattgagttcaggggtaacagtgataggagcagaagctccatcaacctatcatatggcgccaaggacagaaaatcctggccagattgtagtgtcaccaccagccgtagaggtgccaccagttggtgcaggattgatcggaggaactgcagaaaagaagaaaagagggaggccaaggaaatatggaccggatggggcggtcgctagggcattatcaccgatgccaatttctgcttcggccccgcatactggtggagactactctgctggaaagccggggaaagtgtggcctggtagttatgaaaaaaaaaaaaaaaa

SEQ ID NO: 10524 - DNA, 333 bp, Populus trichocarpa
  Predicted polypeptide sequence is orthologous to G1965
tttttttttttttttctttgggccacaaattaattaatgcataaactactggagcctcttaattaagtaaagaaaactacaagaaagatggggggggggggggggctttaattctcttacttcattgatttaacctcaaaacttgaccaattgccaaaaaacgggaaaaataggtaggcttgattcaaaaataaccattgaaaaaacgggggtcttgatcttgagtggcacttgaaaaaaaaaaaggcaaacggaatttcctgaaacctcaaaaacctttaatgctgcgtcttgggggcatcaatctctctgaaattcttgccaaaccccccg

SEQ ID NO: 10525 - DNA, 785 bp, Populus trichocarpa
  Predicted polypeptide sequence is orthologous to G2
ggcggatcataatcttgatttgagcttgggcaatccagcttcgaagcaaaacagtatagaatttggtcaggataggcacaatgttgcaatggagcaacattcagcaaccatgccatttgaacctaattggcaaaatcgggggcttagacccaagcagcttaacctttgtacaagtgacaatgatggacatggaagagatgggtatggagagactgaaacgactcagcttcttagcaaaatccacattcaatctccagcatcactcaagtccagtgaaatgccaagatatgagcagttcaggagatcactcggagatagtcagatgcatccttttcttcccccacagtataactcaccaaattatcaaactcagcatccaagcagcagcaatggaggccgaattggaagtgatctttctctctctccatctgagcttcattataaccatcattatcagcaatggcaagcaggtcctccccggtttgcaaatgctgcagcatcatcaggattccaacagcagattaggactccacaaaactggctgcagaaaaatgggttcaactctctcatgagaccttcttaacccatacataaagtagccgttccatcttccttgctatgcaatctcaatccccaccttgtttgctagctgggtaaaacatgtaaagagcaaggcttttaactacgaggcaggttgtttttcaatccactgtccacccatccccagagagaaccaccaccaagaaaatcacgaaattgttggtcaaaaaaaaaaaaaaaaactc

SEQ ID NO: 10526 - DNA, 537 bp, Populus trichocarpa
  Predicted polypeptide sequence is orthologous to G20
ttttttttttttttttttgtgagtatagaaagtctacatgtgattaatgtacatatacattaggatgtctttgtatattctctgaaacaaacgtaagcaaacctgtaaaaagagtaaaagccttatctcggaagaaaaaattgcaattaggacacttttccttggatttttcacactgaaaccttccaaatacctgcttttttttttctcaggttacaagaacatctggctttctgagggatctgatgctaaaatctcccaaattcctgctcttcttttcccaaatagaaggaacatctgccttcctgtaaagggcggagtaagagttgagacaccatcactcctctggccgaaagaaactataagttgaactggtctcagtctttgtaacctcaggatttcgtgaaagtccagtaggaagagcaggaacaagagatgtccaaaggatggggtctactaagggatcgattgtgttgtagttggtcagaagaggagcagacaagaaaggagtcaatggaacatttctttgaagagacc

SEQ ID NO: 10527 - DNA, 893 bp, Populus trichocarpa
  Predicted polypeptide sequence is orthologous to G20
gcgtatgcctggatctgaatactgcagtagtgtaaactatggtgatgatcacgcagccgaaagtgaatatggtggcagtttttgtattgagagaaagatagatctgacaggctatattaaatggtggaattcccacagcactcgtcaagtggaatccatcatgaagtcatcagaagatactaaacatggctgtcctgacgacattggcagtgaacttaaaacgtcagaacgagaagtaaagtgtacccagccataccagatgcctcatttaggcttatctgttgaaggaaaagggcatacacgttctacaatatctgccttgagcattttgtcacaatcagctgcttacaagagcttacaagagaaggcatcaaaaaagcaagaaaccagcactgaaaatgatgagaatgaaagaaaaatactgtcaacaaaatggaccgtggcaaagcagtagagaagtccacaagtcatgatggctgtagtgagaggctgggagctacattaggaataactgggggattgtctcttcaaagaaatgtgtacccatcgactcctttcttgtctgctcctcttctgaccaactacaacacaatcgatcccttagttgaccccattctttggacatctcttgttcctgctcttcctactggactttctcgaaatcctgaggtcacaaagactgagaccagttcaacttatagcttctttcggccagaggagtgatggtgtctcccctttcattccgcattttaccaaaagacatattttccttttaatcgggaaaagaaggagcagaaattagggagattttagcatcagatccctgagacagccagaggttcctttgtaccctgtgaaaatgcagatatttggaagatttcagtgtggcaaat

SEQ ID NO: 10528 - DNA, 868 bp, Populus trichocarpa
  Predicted polypeptide sequence is orthologous to G2007
gttttttttttttttttttggtcttgaactcttcttcgattttgataaaggaaaggagaataattattaagctacatagcacttccaatatcttcctttccctagttcttttccaagatttgaatggtgggatgaagaaaaaatttacaagacttgaaattctactatccaggaagcttgagctttcaatccttgtgcttccttcctcattacttgatacaccttgcgatcattctatgaggtagtgcattttaatgcttgccacccatgtctaggatactcaagtccatgtcactgaaacaactaagtccaaagaattcatctccaagatcctgagagtctaaaacccatggagagttactatcctctgatgaagatttagatagcccgaattcactataatctcctcctctagtggcttgaaagttccaagatgaatcatcaagaaatacctccgaccataggcaactcattagtggatcactgtcagtagtactgttaggttctgatgaccctatgcattcatccactgaagaattttcagtcggggtggtcgtgcttgaattatcagtagtgctagaggaggcatggccacaattttgggggaggacctgctgaccatcagcgttaaaattgggttgatcataattactgtgacaaggtactgtactttcttgcggacttccttgtttattgagaggctcgtgcgtaacaggatcaattcccatctttattagctttttcttaatgtgggtattccagtgattcttgatctcattatctgttcttcccggcaatcttgctgcgattttggaccacctgttgccaaggcaagcatggaggtcaatgacaagttgctcctcatcct

SEQ ID NO: 10529 - DNA, 917 bp, Populus trichocarpa
  Predicted polypeptide sequence is orthologous to G2071
ttttttttttttttttttaggataacatccaacgaaccacggtggtaatttattgcatattttacaaatcagcaactgattttttggggaaaaagaaaagggatcttcatattttacaaaaacatactgcatcatcttttattattcctcctaaccaggaaggctgaaacccaattgctgaactattattggctaaccgcgataaatcaccaaaaaatccaccattagtattagcctttgcagccactggaatatcctccctcaccaccccagctctcaccaagaactcctccaaagttatctctcctaaggtaggctgcctctggggcacattattagcaactccagcactagtcccattaatagcatattcctttgacatgtctttccagacctcatccaccgtcttcaggctcagtgtccgcggcagcgtcagcgagccctgtcgctggagaccaacaccatcttgtaccccagcagaggttgctgttgccacggtctgcgtctcctctgcactccatatactctttaacagctcatccatgttcattgacccaaaatccttccctaatgatcctcccatggtgttttgaagttcttcaagcgttaaagaatagatcgatgactgactagccaacggaaaattccccggtggccggccaccaccggcatctgacgggtcatttgtgaagctcttgaaattgaaattagtccccattttcaatatatctggataaaacagggtcaaaacagctaaaaaatctgacaactaaagccaaaaaaaagttaaaaaccctagccttattgcatttccaatcccgtgatgatacttatcaaccaaatcccgcataaaaaaagtaaaaaagtcttcaactttttatttttcaaaacaaaaaaagcacgaacctgagaacaca

SEQ ID NO: 10530 - DNA, 899 bp, Populus trichocarpa
  Predicted polypeptide sequence is orthologous to G2085
ttttttttttttttttttagattaaagcatttggtagtattaattaaagcatttggtactatatataaccagcaagctacatcatcgaaacttctatgtgatacatccagagtagaatcctatagaggtaaatctcatgcactacaaaggtaaggacgagataacttcatgtattgatgatgatggcactataacatctgtacattccactggacaagctggaattaattactagaaaaccttcaactttaattgatgccgactgctatagccattctttaaatgcaactcagaaacacagtcaatgctctgttattaaggctgtatcaccaccatttgcgtaagtaacaagattgttgtctgtatcaatggcagttccagagtccgaatcattggcttcagcttcaccctgctcaatcagagtagcagaatgatccgttttcttggtgaggtctctcaaagttcccctgtttgcccaaaaaaagcccacaggcattgcaaagtgaccttggaccagatggaccacgccgcatcattggggtggattttgaattagtgccacaatgcgtacacgaggtttcttgttggctatcatctagtcctgaatcctgaacaccatcccagccatatcctccctcagacttcttggcagaagtaaattgacccttattccgttgcatcctgagtgcaacctcctgacggacaccatatctaactttcttatcaaagcatcgctcttttctcttctgccggaacctacttaatgaagctgctcgttgaggttgagtacaccgtgacgggtagtccaccacacccctttggttttgaggcgtcatttccagaccaggagttaattcacatcctcccagtaataataacacagcttgaaccttatcggg

SEQ ID NO: 10531 - DNA, 893 bp, Populus trichocarpa
  Predicted polypeptide sequence is orthologous to G2094
ggtctgtcggctctctctctctctcactctctctctcggtgaatgtcggttcatttaaaatcgacactcttatcattcaccaaaccatctcctgattcttgatccctgcacattaatagagtgcttgtctgagttactgatttgcttctacttgatctctcttcctccaaatccacaaatcttgtcagatctccctgttctgatcagtagagcttttagtgaatccccacttcgaagtacaactcaatcattagtgttattcaaaacctgtttgaggaaatcgtgttttaggaactgggttgtctttagatctcaacattagttccttacaatgttggatccagctaacaaaggatcagagtctgaagaaatgagtagcaattcacaagaaacagagagcccactaaaaaagacttgtgctgattgtggtacttcaaagactccactttggagaggtggtccagctggtccaaagtcgctgtgtaatgcttgtgggattagaagcagaaagaagaagagggatattttagggttgaataaaggggcagcaaatgacaagagagcaaaaaagggaagcaataataatggctcaagcaataacaacaacaacaagcagttaggtgatggatcaaagcagagattattggcactgggcagagaagttttgatgcaaagaagaaagctgggtgaagaagagcaagctgcagtgttgttgatggcgttgtcttatgggtctgtttatgcttaataagagtcgataatatgtgttaataaggggattgagaatgtattagctggctagattttaagtgcgtgttgtgatttgttgttaattttttttagtattagttatcatttttttttaggtgatttgggctaacagagtctgggga

SEQ ID NO: 10532 - DNA, 523 bp, Populus trichocarpa
  Predicted polypeptide sequence is orthologous to G2107
cggaatctcaacactctcacaagtcattcattatccgtgcccaaaagttcaaagcggacccataaaccctatacaaacatcactagctcttaaaaaatggtcatgggaggatcaaatgcgttctcacctgacaagcaagaatcatctttatcatctttactatccgatagtagcgggtctcagcaggactcgcccagttcgaacgagaaagtcttactagcaacaagtcgtccgaaaaagcgtgcagggcggaggatattcaaggagactcgtcatccaatctttagaggtgttaggaagaggaatggcgataaatgggtttgcgaattgcgtgaaccaaataagaagtcacgtatatggctaggcacatatcctacacccgaaatggcagcccgggcacatgatgtagctgctttggcgtttaggggaaaatcagcttgccttaattttgcggactcggcatggaggttgcctgtgcctatttcaaatgaggccaaggacatcaggagggcagcaagtgagg

SEQ ID NO: 10533 - DNA, 921 bp, Populus trichocarpa
  Predicted polypeptide sequence is orthologous to G2107
ttttttttttttttttttgacagtaaccctaaatcttattactcacttcaattttcacactgctgcagatttctaccaaacaatccaacccagaaaaccagaggtatgacaatatttgataattttatccgtactggcaaaaatataagtccggattaccttaattatcatcctaattactctactaataactaaaaatattaaacagaaaaactccataatgacatgtcggtgtcattattttccatgttatccaaactatccccaccggaataaccacaacaattaggtggcggcaataacatcccttctgcaatattagccaacaaacctggcattccaaaatctgcatcatcatccatataaaacacatcccccgccgccgtccctgcaaccttctcaacctcatctcccgtcctcgttaactcaactcccagactcccctccggccggaaagcctctgctgcctccgctgcagccttctgaatatccttagcatcgctggaagccggagtaggcaacctccaggcagaatcagcaaaattcaagcaagcagacctccccctcaacgccaaagcagcaacatcatgtgccctagcagccatatcagccgtaggaaaagtccctaaccaaatccttgatttcttattaggctctctaacttcacaaacccacttacccgaattcctcctcctcacccctctatacacaggatgccttgtttccctaaacttctttcttcctgccctcttcttcggattcctggaagctaatattacttcctcatcagaaaaaattgcacctggttgaactcctttagtaacactactagtgatgctactatctgaaagaacagaagaataagaacattcttgctcgtcaagaactgacaacaaactcattgacccaattgggttctga

SEQ ID NO: 10534 - DNA, 962 bp, Populus trichocarpa
  Predicted polypeptide sequence is orthologous to G2107
ttttttttttttttttggggcttaaaagcagaactctctcgcatttaatttgtttattcactattacagtaatagattatggcttagccattattacatgatgcgattgtgattcctttgacacacgaacagtaaccctacatcctgtagcttcttcaattttcactctctcccgcagatttcttccacacaatccattctaacccagaaaacctaaaccgccacaatattcaattgtatctgtactagtaaaaaatataagtacagacaacatcgactcttatcttaattactctatcacttacaaaaaactatatagaaaaactccataatggcatatcagcgtcaatattttccatgttatcccaaccatcccctccaccaccacaatgaggtggtggcaataacatcccttcagccatattagccaacaaccctggcattccaaaaacagcctcatcatccatataaaacacctcctcccccgcctctgcagtagtccccgccgccttctccccctcatctcccgtcctcatcaactcacctcccacacacccctccggccgaaaacccccagctgcctcagctgcagccttttgaatgtccttagcttcactagaagccggaaccggcaacctccaagcagaatccgcaaaattcaagcaagcagacctacccctcaatgccaaagcagcaacatcatgtgccctagcagccatttcagcagtagggaaagtccctaaccaaattcttgatttcttattgggctctctaacttcacaaacccacttacctgaattcctcctcctcacccctctatacaccggatgccttgtttccctgaatttctttctccctgccctcttcttcggattcctcgaagctagcattacttcctcatcagaaaaatttggagctggctgaactcttgtagtaacatactactaatactactatctgaa

SEQ ID NO: 10535 - DNA, 912 bp, Populus trichocarpa
  Predicted polypeptide sequence is orthologous to G211
ttttttttttttttttttatatcaacttaaacgtacaggcattccatgtaaatacaacactcacaagaacaacatatatatataacacaaattagcacgtatttatagtcgtaacaaaccagtctgattttctttatatagaaatcttctgctgcaggatcaagctagatcataactatttaacgcagtaccatctttctcaccgaaagctgccattgaagatgtgacttcagcttcccaaatactgccatgatggaaagcctgtgaagaagaaatcacaggttgacctgatggtccaataatattacactgttgttgttgttgatacgcaaatacattttcattgatcagagaatccagaaacaaagagaacgtgtcctcattttcatttccaatgtaatcttcctctttgttttgttcatgatgactttgtaaccccttagtaaaaccatcacaattaggccagtttttggcaccatcatcaatgacctgatttggaaactgatccaagttagttattgttaagttcccaattactctagtggctgtagctcgatcgaccctggcattctcttctagtggaaacgaattagggttggagttttgggtggaagcaatattggcaatctctgatgaattagggttagggtataaaggcttgtgggtccttggatcaattccttgactaatgagcttcttgcgcagatgggtgttccagtaattcttgatctcattatctgtgcgtcctggtatcctcccggctatcaaagaccacctgttaccaagcaacctatgaagcctaagaatgagatcttcttcatctggggcaatacgtcctctcttaacagaaggcctgagatagttcatccatcggaggcggcagctcttaccacacctaaaaagccctgcctg

SEQ ID NO: 10536 - DNA, 475 bp, Populus trichocarpa
  Predicted polypeptide sequence is orthologous to G211
gccccccctcgagttttttttttttttttttggcttatttagtatagctagctagttttagggtttcactgtatatatgttgcggattgctcgtgaaagagatttccttcactttttttttgttctcattagagtttggtcaattaacattcgagctggctttgatccatgtataatttacgtgagctctctcttcaattattttatagctagcttagctcgaaacctgcatgaatctggttttcaatgaatcatgtgcttgaatcttgtaaacgatctgtgttcttaaatttcaccttcttcttcgttcaagatttgagctagaaaggaaatgtatatcactttactttgaacaaattttagctagatcttagcttggactagctacttgtgttgatttggtcaatgggctgtttctttaggtggtcattgatagctgggagaattccagggcgtacagataatgaaataaagc

SEQ ID NO: 10537 - DNA, 927 bp, Populus trichocarpa
  Predicted polypeptide sequence is orthologous to G211
tttttttttttttttttttataatctcatacattgtttgggtaatattttggatacaagaaaaaatagtttatgttctcaccaatacaacacaacagcaaatgataaataggatgctgaagtaaaacaataacagtagatatgtagaatacataaaataacaaaccaaatcctagctttgtagtttttgtaaactgattaccaagtgtaatttcatgccttgataaaagcaaagatgactatgatagactactcaacacggtgatcatcaaccctatttcgaatcattttgatcaagagcagaaggcatgagagtagattcccagccagtactaagtccaaatgatgttgcggcagcaattggaaacaaaggatctgtactggctggtgcactattcacattaggctcattaaagatctggtgttgttggaaagcctcctcatttatgagtgaattgaggaaggaaaacacatcttctgtgccagaattgatatcttcagcttctccattaccaagcctttgattacctctcaaatccgtcccaaaagaaccatcataattcagcaaacttgtgtagccacgacttgcaataaaatggtccgtgtaatactgatcacccaggtgtgcattactgttgttttgaaaatacccattctctttgttgctgattatgtgagcactgccactggtagtttcttccaaaccagaagaagcaatcttaataggctcttttaggctttcttgcaggtggttcgctttcgacgaagaaggtttggattgatcaaaagattgaggattgatgagaggcttgtgggttcttggatcaattccttggcttatcaacttcttactcaggtgagtgttccagtaattctttatctcattgtctgtacgccctgggattctcccagctatcaatgaccacct

SEQ ID NO: 10538 - DNA, 921 bp, Populus trichocarpa
  Predicted polypeptide sequence is orthologous to G2130
ttttttttttttttttggaggaaagaatctacatatttttgcagattgcaagctaaaacttacaatttttagacaaaactactacagctaaaatggaaaaaccaaacaagtcggtactaatccaaaactcccctcggaatttaccaaaccatcataccagtaggtagatagctataaccttaaaacccaaatagagagtgattaagcctcaaagtacttgtcgacatcccataaacaggagccgaaatcaccatccaaatgtaccgagatatcagcataatcttctctcaaaacagtatccggtacactacactcctcaaaaaaaaaatcggagcaggattttcaaaatcccaaaactctttcaaacacaaaggatccgtaaccaaacactcatcatcctcaccgacctttattatttcttcttgaaccacctcttcttgcgtttgtatcctccagcaacaatcactctgtacggcaacctgtgactctggccccggttcctctgtagattgaaatctaagcacagaagttggagaacacagactattatgagattctttaccagactcatacccagaaatgttaacgttaatatcaacatctggggcatgttgtttgctcaccggaggttgtgtaaaattggtttgtgcatcaggtcctttaatacgaatagcagcctgatcataaaccatggctgcctcctctgctgtatcataagtccctaaccatagccgggttctcctataagggtctctgatctctgctgcccacctcccccatggcctttgtctcacaccacgataccttttcccccctggataagaactctgatcccttgaaatttttttcacaacttgttgccggcttaccacttttgaagatttttttgcatcttctgctgctctgtcgctcccacaactt

SEQ ID NO: 10539 - DNA, 526 bp, Populus trichocarpa
  Predicted polypeptide sequence is orthologous to G2144
ctgaaaccaaacacgccacaacacaactcataacagaaaaccgagcactccatcatttgaccctctgtctctctataaactgaccttcttaaattaaattaaggaaatggatcttacaaccgcatccggagctagatccggacccgagcttgacgaaaccggactggattccttccaactcggtgaagatatccgtcacttaatcactgcgccatcagaaaacgcgagttctttcattgctttactagaattaccagctaaccaagccgtggagttgcttcattcggactcgggtcaaaaacagtacccgaacttgacttttccctcaaacacttccgccatattctccgtttttaatggcggtagtaattcaacggattccagccccgttccgtcaaactcgagctcgaaggatctcgagaaagcatcagccgttaagtgtgagccattagagacggggtcttaccttgattcatctcatccgttggtctctgatccaaccgtggattattcggcgccaaatgca

SEQ ID NO: 10540 - DNA, 782 bp, Populus trichocarpa
  Predicted polypeptide sequence is orthologous to G217
ttttttttttttttttttcccttcaatttcttcaatagtggtcgggaacttaggctgttccacaggtctatcttcgtcagcaacatcataaaatccaggaggaggtctcttctcaaagggaatttcagaattatagtctatccccttccttttccttctccgatgcctattatcaataccagcagccttcagttccctccttttctgcaaggaagcaagcctcctcgcttcttcaagctgtttctccctagcctttcttttagcctttttacctttcatatttgctaacctagctcgtgcttccgaaagcatctccttctcatcctcatccatatcaacaggatccggacgtgcaggcttagattctgggttcggatcaatctcaccaggacgcaacttccgtggatcatcaccaggatcatagttgtcgtccttaacacaagctgcatcaagcagcttctcgtaacgctcaaggcattgtgaaggagtacgtccaacaatcggggcaatcgtcctccactgcgtgggcatgagcttaacaagatgaagcaatttctcatcctcttctctagtccactcggtctttttaatggaaggatcaagccactcataccaacgagctttacattgcttagcagatttacgaacaagaagagaagaaataccagcccattggtttttgccatatttcataacagccgcttttagaatttcatcctccgtgttcttccatactccaccttttatcatgatcctcatcttgcttgccttttcttttgaat

SEQ ID NO: 10541 - DNA, 925 bp, Populus trichocarpa
  Predicted polypeptide sequence is orthologous to G2226
ttttttttttttttttttgggtggagatcaaagcaagatagataggttaaacatcacttcttcacaatatgtacaataaaatttttggtctctcaaggacccatcagcacatcatgcttgatctcaagcacaaagtatacaccactatgccctgcccgatgcactcacgtaaatacatgtacacgctgtacaaggagaattcctctgacaaagcatacatggtagtatgcgctcaccaaaagcaagatgcatcctcttcaggcagcaatggagtcctgcaaagagggcatgtaatgttccaatagtccaaccacttctccaagcacattttatgaaagatatggccacatgacaggctatttatctccgattctggctcaaattgggtcaagcaaaccgagcagtcatgttcaggctgtttacagctgcacaccgtgttgaatcggattgatggcatcctgcttcggaactcctcaatgtaattctctgggggacttaaacgaaattcaaacgactctctggtgtcttcagcattatctgacgatgggagtgaagcagatggtgacaaacggatgccaacaatgtgaaggattgaacggactatccctttgacaatggaaattgacaaggcagtgtttactaaaagcacacatagtactccttcagatggagctggcagacttgatagacccattgaagtttcgtgggacttggttttttttgcagtgattccgcaaagctcaagctaacaagagattcttgattcacagtgtgctcaaatggaagttatggaagccaatggggggatacttatataaatcacagttgaagcgaatggagaaaaccggatgattccttcttttcttgatcttggggcatataaacagggtttttgactatgatgaaatgatgagtagcaaaatcc

SEQ ID NO: 10542 - DNA, 706 bp, Populus trichocarpa
  Predicted polypeptide sequence is orthologous to G2239
ttttttttttttttttttcttttttttttttttttttttttttttttttttttttttttcccaaattgacctgacctattccatgttgatgatcttatattaaattacattaatcacaaaaaaataaataaaaaatacccatcttacaaatgttgacaaagtcaaaaaaaaaaaaaaaaaaaattaataggagcatcctaaagctttggacaagcaaaattacccttctaaaccgggggtctgctaaattcacctccgtctgatccaccgagtctaaacaaacccccttggttttcactagcacccaccacttttggtgacctaaccaacaataaagctctcgataaaaacgacaaccctcttgctaaaaatgacgggttcctaccaaaaacccaccggtctgacctcagttctaggtccaatttctcaagtctcttataatttaacacctttcttgaactcccttcaccaactccggtcctataacccttccttgaacttccttgtctaggcagcaccaccatactcgtaaaccggttcaacttccggttcatcacctgtttcctaacctcaaccggcaatctcaaagtaaagcgatcggtgttctctcccggttgaaccaaaaaatgcccggtcgaatgtgaccaaggaaacctcggtggcctacccgatcttgacccacgtgtccggttcctattcaaagttt

SEQ ID NO: 10543 - DNA, 588 bp, Populus trichocarpa
  Predicted polypeptide sequence is orthologous to G225, G682
ttttttttttttttttttaattaactcaccattaccacattcaagaagaaaccattgtacaaatatcttgatcacaacctaaacccacccatattgcaggctcttagaagaacgctacaaaaccacccaaaattttgctactctagtacatcagatagggcaatcatcttggacaaccctgatttactgacttgtagagtatcttgaagtccagtacttctcaatttcttctgctgttcttcctggaatcctcccagcaattaagggccacctctcaccaaccagattgtacatcctggtgataagagtttcctcatcttctgagaattcaagcttggaatcttggctggtttcctctctagaatcaacagagttgtcatcactagaggagtgatccaagtcagccatatttaagttgaaagaaacttgtgatgaacagaaatttctaatcttgagtctatggaagctgactgagtgtgaaatttaagggatttgataagtggagtattaatagagggaggccataaagattcctcacctcaaaaggtggtcatcaattgatggagaagaatgggcggtggtgtggga

SEQ ID NO: 10544 - DNA, 410 bp, Populus trichocarpa
  Predicted polypeptide sequence is orthologous to G225, G682
ccctgatctcgttccctgtattttttttcctcactgaaactgctcaggggcaaaaaataaaaaaaatggatagacgtcgcaggaagcaagccaagacaacaactcattgctctgatcaagctctttctgtgtgatgatttggtagaggtaagcagcattgaatgggaattcatcaacatgtcagaacaagaagaagatctcatttacagaatgtataagctggtcggagacaggtgggctttgatcgcaggtcgaattccaggccgcaaagctgaggaaatagagagatattggattatgagacactgtgaagggtttgccagtcgacgaaaggaacaaaaaagagatgtaattcctaatacctcttaattaggttgtatcaatttgtttggaaaaaaaaaaaaaaaaaa

SEQ ID NO: 10545 - DNA, 591 bp, Populus trichocarpa
  Predicted polypeptide sequence is orthologous to G225, G682
gatttctttgttttctggctaatttctgctccatttgtgtttttctttctgggtttcatggttattacaagattgaaaattgttagtcctttatcttaagctaccaatttgaaacttaagattggatttttttcatgggttataaatcgcagatacaagccaagattccaagcttgaattctcagaagacgaggaaactcttattactaggatgtacaatctggttggtgagaggtggactttaattgctgggaggattcctggaagaacagcagaggaaattgagaagtactggacttcaagatactctacaagtcagtaaattagggatctacgtccaaggtcctgtctgatgtcctagagttgtcaaaattttggctggtttgtaacaaaatctggttctacttaggaactgcaatatgggggtttagctgtgatcaaaatatctgtacaatggtttttcaatgcggtaatggtagttaattaatgtttgggagctagattgtaagatgaaatctgcttgttaatatggtaaattgagaaatttttacaaaaaaaaaaaaaaaaaaaaagaaaaaaaaaaaaaaaaaa

SEQ ID NO: 10546 - DNA, 912 bp, Populus trichocarpa
  Predicted polypeptide sequence is orthologous to G227, G242
ttttttttttttttttttacataatagacaaacttggattagaattgaaagatttgttgttttccttgttcttgttgcaagtttttttcagttccctcgtcagaaccagatccaaggttacaaaatgtctccgtttttaccatttcccctcgcccttgcccctctctctctctctctctctctctctgtacaatcccaaaattattccctagccaaaagagaaaacagaagccccagtttcctttctaccctgtccatttttcactacttaattttaccaacccaaccctattattcactgcgacattcctaaacccctccccactcatgccctgataacacatacccccacctacaccactatgttccatcatataattcctcacttccttccttatcatctcttgcatcaccgacataaactctgtattgaaccccacagacccggacagtccgcccactgccggggacacctcctgagccggtgcgttccttcccgtcaaaaggggtgtcactgtattggatttgggcagctgagatggctcgccgacttggttggacacctcagaggaatcggccccaggtagagacaagctcagcgaggtaggcgggtcgttgttgttatcagaagacgacgtcgtttcaactggaggcataaccgctccggttcgggcaacgggccggtatatattataattataagaggaggataaaccgggcaagctggagtcgctgacgtcagatccagaggggctgcccgggctcatatagagccccgtagaaacaggcacaccagaacctgcactcacggatctcttcaagggctgcgtgttatcaccatccaaattaccatcatacccttcgcggttgcagaaattgccatcctctgccattgaagagcacttgcgtttc

SEQ ID NO: 10547 - DNA, 812 bp, Populus trichocarpa
  Predicted polypeptide sequence is orthologous to G227, G242
ttttttttttttttttttccaaattattacttctgtataaagcaacgattaaagcaactttaaagaaaacaaattaaaaaaaaaaaaaaacaagagtttttttctcctttttgccctcctctctcattctctctccgagtcaactcagctgcttcatcatcatgcccagatgatcatgatcatggccgtcactaacaatctacttctcttctgcttggctactcgattctgctaataccaattcgtttaaccacagcgttccttatagcctctgttcccaaacagagcccattttgctcaatcccggacatatagttcctcacttccttccttatcatctcttgcatgactgctaaaaactcagcactgaaaaactggttctcaagtcgagacccaggattcttctgttgcagaaatgaaacttgctcctgttgctgcacagccactgcagcttgtgggggtgcagcaggtgtttgcaccataggtgtcgggttaacaacatgggatccagaacttgagccagaacccggagcctgacaagtaatggatccaggcagagacagggataatgaagtcggtggatcgacggtcggagaggacacgtcaatcgacaaactaggtgggacaagagaggcggttttgactggcggcctgaaaacgggagatgaattcacgccgggtatacttgaatcgctcaaatcggatccggatgggctactcgggttcaagtgtagacccgaacccgccccgagacttgcggatcttttaagaggctgttgttgtgcgtcgtcgtttaagtcatcaaacatgga

SEQ ID NO: 10548 - DNA, 566 bp, Populus trichocarpa
  Predicted polypeptide sequence is orthologous to G2343
ttttttttttttttttttggaattcttggattaaaaagaagatacgaaagccttcagctcctgcaacaataaccaatgcaactaccagtactgatcattcaaatataaattataactcaaaccaactagatttaggtcatcaagatttgacaaggccacaagttcaagaaaccctattttcgtcttcagctcccttatttatgtttgacaccagtactgcctcacttgatggaattgtggatagtagtgtacgtggggagctttttcatgattcggcaagcttaaacactgaaacttggaattcaagccagcaccatcatgttcaagcagtactgcccccccaagcaacttttagtattggaatggatacaaattacttgcctccattgattgacaacatggagaacatggtgcctattgagatgcaatcctgtagcatgaatgacgaaggagagatatcattggaatgcttacaaaggcaagagttgaatattgaatgggtggaatcccaacaatgctcaaactttcttttttgggataatgttgaaggaccacttggtggagaa

SEQ ID NO: 10549 - DNA, 866 bp, Populus trichocarpa
  Predicted polypeptide sequence is orthologous to G2394
ttttttttttttttttttggctattgggcaaactggaaagagagtgccacacagattcttaaaagagatttttgatccatgagattcataaaaagagaagaatgaaaaaaaaatttacagcataatcaaaatcgtaattatttatgtatgatattactattttgtgttatatagaggatcaaaacactgcaccagccccgttttcgacccgtctctggctagaacttaacccagagagagaacctaaaagactttcaccgacctcactcttgcaaagaggacatgatgcattgatcttcagccacttatctacacactccttgtgaaagaaatgagaacatggcagctccctcagctcgtcattgtttgcaaattttgccaaacaaatgcagcaaactgcatcttctcccgagatcactcgttccttttctgttcctgcagccacgaccccaccatcactagctcctgcactgctatcctcaccatttctatttttaattaacttaaacttgtatgttggcaaggcatcaattgattcagttgtggctccccttgtctgtgtcagatcctctctatatccaagaacggaaattatacaaggcaagcaacagcagattgttgcacacagaatgaagggcatagcgtatccgatacagctaaatgtaagaaacactatacataacctgtacaagtttggagcctcctcagcagatgagtggcctccaaatatccacacattgcccaccacaaaccaaactgcgaaaaagcaatccaaagccattttgaagtattccaccaaaaccttgagtcttgcatttagtactgcattttggctgcctctaggtgatgtagtggcagatcggcgc

SEQ ID NO: 10550 - DNA, 823 bp, Populus trichocarpa
  Predicted polypeptide sequence is orthologous to G2457
ttttttttttttttttttagcctttaggaatattcatatagatgacgaatgtaaataacttacatcaagtcaagtaagcaatcacatctgctaaacagtcggggacaaatacaatattgtagaaaacatagactcatatcctccttgattacaacacattgaagtcaaggatgtacttcaaagagcatggaatttcttgaaggtggtcttgaaatatcaaaaccatattgatcagttgttcagtagtgctgaccttgacattagatgcttatcacttccatcatccagcttagcttggttgttggtctccaacatcaatccaaattgaatatgagggaaatgtgcccaattcttggcagcagtactgaaagcttctctgtgactgatctcaggattattggccttgatcctctgaatctcctcttttatgaactgattatatgcagaaggtactcgctgcctcttctcgggagggcgattaacaaccctttcttgagtgacaatgttggtagctggggttctcgttgagatcttgttgttgaattttgaggaggaacccatgtcaattctgtaatcatgtgatatgtggtttgatgcctgaacatgatcttgccatgacagtgactgaaaggcagctgccatgttcacagaccatagattggtgcagtgcccacatcggacggtgacaatgtcaaacaagttgctgcatggaacactgaccgcaagaactatattgcaaaagttgcaagggatgtagcagagctgctcatgaggcaccacatcgacgcagcttgacatgatgagttttttaaggaaattaatt

SEQ ID NO: 10551 - DNA, 891 bp, Populus trichocarpa
  Predicted polypeptide sequence is orthologous to G2457
ttttttttttttttttttagatattgacgaaatgaaaatagcttccataaagttcttacataaagtgaagtaaacaatagcataaacagttggtcacaaatacaatattggagaaacatagattcatatatatatatatatccttgattaagacacgttgaagtcaaggattcttaatttacttcaaagagcatggagtttcatggaggtctggttttgaaaaatcaaaaccatgatcaattgttctgcagtgcagaccttgacattagacgcttctcactgccatcatccaccttagtttggttgttagtctccaacatcaatccaaaatgaatatgagggaagtgtgcccaatttttggcagcagtgctgaaagcttctctgtgactgatatcaggattattggccttgatcctctgaatctcctcttttatgaactgattatatgcagaaggtactcgctgcctcttctcgggagggcgattaacaaccctttcttgagtgacaatgttggcagctggggttctcattgagatcttgttgttgcatttggaggaggatcccaggtcaattctgtaatcgtgggagttgtagttcgatgcctgaacttgatcttgccatgacagtgactgaaaggcagctgccatattcacggaccatatattggtgcagtgcccacatcggacggtcacgatgtcaaacaagctgctgcatggaacactcaccgcaagaactatattgcaaaagttgcaagggatgtagcagagttgctcattaggcaccgcatcgatgcagcttgacatgatgtttctcgaggatattaacaatcaaaagattataaggtctttaggtcaagaagaagaagaaggaacacaacaaacaagaggaagc

SEQ ID NO: 10552 - DNA, 942 bp, Populus trichocarpa
  Predicted polypeptide sequence is orthologous to G2457
ttttttttttttttttttgcaagcacgactatgtatattaattgttcgttactgctagcattcttctgcgtataacatccacttaaatattacacgtctttttgtttcccctaacacagtcttgcaactagttttattcaaaatggtccctgtaaaagtcactgattattacaataagcaatgaaggtaaagctttggagtcttgcgccagaccgaagctgagaattcattgaaatgaacaagctattatcaaaataatcacaccatgattactttagtttataaggaaacttcttggcaatgatatggccaatatgtttttattaggctccttgctgcccggacgtacgtgcaccttatgcatccatgccggtgtcgttgagtgttagaccagactgggtgtgagggagatgagcccagttcttggctgcattgctgaaagcttctctgtggctaatctcaggatttttttcttttatccttctaatctcttctttaataaatcggttgtatgctgaaggagtccgttgtttcttccccgttgcagcatgcactgctactgttctgctgggctgttcattctgggaaggttccaatgcagaaaccttattgcccgtggaagaagactgggaaccctcgcttaaatcttgataaagcaagttttgtttatgagaattttgaggatgagaagtctgtagcaaagatcccgtattcaaagacagcaaattagcacaacgtccacacctaacagtcacagtattcagcaatatagaattggcactgcatggaatattaacctgcaaaaggattatcccaaaaaaaaaaccctcaaattttaaaattatatagacatcttgtaaatggaactgaatagattattaaaaacagaaattactatatgagctttcaaatttatatgcatatatatagtaaaatctctcc

SEQ ID NO: 10553 - DNA, 838 bp, Populus trichocarpa
  Predicted polypeptide sequence is orthologous to G255, G664
ggtctcgagttttttttttttttttttgcatacgaaagcagttgcgctaattatcttctctttattttcctctttaattatagaacccagagactcttcttcaagtactgaagtagtagtcgtggtgaaagatattgttgttgtggcttcttgtactgctggttcgttgagtggcctatgagttgcgggatctatgcctctgttcaaaagcttccttcttatatgtgtgttccaataattctttatctcattatctgttctccctggtaatcttccagctatgagtgaccatttgtttccaaggaggctatggagtttgataatgagctcatcttctgcttcggtgaaattgccacgtttaaggtcaggtcttaaatagttgatccaacgaagtctgcaactcttgccacatctaagaaggccagcggctttaggaagtgagcgccagcaaccttcaccgtgagctctaatgtaagcaacaaggcgatcgtcttcctccttggtccacgcacccttgtttgtatgggctttggtgcacattgagcgcagacaatgttggctcatcccaccaatacctcttctcaccactactgctacatttcttagcgttatcatctgctgctatcgatgctggacactcacatgcattgatttcaaatcctttgtaggaggccacgaaagggtgcgtggctccaatcagtcttgacacggcgaaaacctgaaactttacactcttctccaatggcagacgaagccaacagaactgctttcttagagcttcaaggtcgcatgattgagaccacttctaaattcaagcaggtccagaaccagatacgaa

SEQ ID NO: 10554 - DNA, 717 bp, Populus trichocarpa
  Predicted polypeptide sequence is orthologous to G2575
ttttttttttttttttttgagagggcaacaaagcattagcggcatcgtgaccattacagaatcatcattaaatttacaaggaaaaaggagagagcacgccgaactgaaagactttgacaagaagaaataaattaacaaacccaaatattttaattgtgaattatctgatctccttgcatagtgtagcgacttgaaattgaacatttacacgtgaaagtcctatcagcaccttctcctctcacttccaattttggcagactcaagcaaactgccgttctcttgaagggaaccccatcatttaccttttgacaaatgggaaaagggcctttataggatcaatcagaatactacatacacaccaacataaatacatgtgtgtatatacatgtacataaactccagtagtcagaaatatgcattcaatgctctatgtgagcaccatactggtattagttcgtccatgaaaatccaagtacactaaagaaacagacagattaattatgagagggagagagagactagagagagttcaaggctgtttcttgtggatgaaggagggaactaaatcttgcaagaggccgtaatccggagcatagagctgatgctgatactgtggatcatggttttgatagaaaatcgaagtttggtcgccttggttacttggtggaagcaagcgagtcaggaaatcctgtggaaagctctgccctatcgatgtgc

SEQ ID NO: 10555 - DNA, 836 bp, Populus trichocarpa
  Predicted polypeptide sequence is orthologous to G259
ttttttttttttttttttctgtaaaattgtatatattatacattttcaacaagaaacatatgttaacttcactcaatcatgtagctgacataaggggggcttgtgcccgttttaacacccttaaagatacttggcaatgtacagatcttgttcattactacagcaacaacaacagagaatacaacttcaaacttttctgtgtctaattaagctagctacttcatttttttttgttttagtagctgatgacttgtccttggattattctacaatatggcacacattttatttgcattattgagatagtaaaatggttgcactttctctaatctctgctctcttcctcttcttctccctctccccctcgacttccaatctcacaccaaacaactttggcctttcatcttcctcttctttctccaaatgtgcgtttttagctactaaatcaagtagctccttgcactttcttttcatgctagtaagctcagtgctcaagaccccattttctttcttgagtcgtttattttcatcaactagagaagtgtattcggacgatgataaagtggatgatgatctttgatcttcttcaaactcttgtggtgcgacttgaattaacggtgcaataggttgttgcttgttagtccaagcttttcttcgacgaatttggcgtagtagctctctttctcccttccgaaacatgtcattgcaaaactcccaccggctcgttgcaacttttcgaaaaccctattcataacaatgacacgaaagaaacatagggaatctgtccttcgactcaaagaaggcaaaacaaaacgtgcctcaacaaaatgacaaaa

SEQ ID NO: 10556 - DNA, 599 bp, Populus trichocarpa
  Predicted polypeptide sequence is orthologous to G2604
ggactggattctttgttcttgaagctctccaagcttgtttgtttctctaaatgatatccaacaaatattcttgcatggcaaaaatgggagaaatggctgtgctttgtgtgtttgagactatgtaagcttgtaccaaatcgaagaataaagattagctttgtgaggttttgcaatgccagttcctcttgcaccttatccaacacctccagccccatatgctcctcctgctccagctccagctcctcctcctcctcctccagccaacggtgcacagagccagctcgtgtgttctggatgtcgaaacctgttactctatccagttggagcaacctctgtatgttgtgctgtttgcaatgcagtcacagctgtgccacctcctggcacagaaatggcccagttggtttgcggaggttgccacaccttactgatgtacatccgtggagcaacgagcgtgcagtgttcttgttgtcatacagtcaatctagccttggaggcaaatcaagtggcacacgtcaattgtgggagctgcaggatgctgttgatgtaccgatatggagcacggtctgtgaaatgtgctgtttgcaattttgtcacaccag

SEQ ID NO: 10557 - DNA, 867 bp, Populus trichocarpa
  Predicted polypeptide sequence is orthologous to G2632
ttttttttttttttttttggcagggtaaaagaggtaaaccctctgttcacacataaagaaatgatcacacgaaagttaagttcaaacgcagaccactggaattactacatttgggattaattcctgcaaggtagatacactagtttttgccatatttacagaagcgacgaaaagaagagagatgcaattagttcaagtctgaagacagcatgaagtccatcacaacatatgatatgctccactcacaccaccagcatgcaccaagtaacaaagacccaaagccaagaatgaattgcctgagaaacaccacacgctgaaagtttcgccccccaagttggacatggctgatgcctccagctttgcaactcaaggtggaaatttaataaatggagacgttcccattagacaccccattcccatgtgtggtttccttctgctgacccaagaagctgccatcatctgataatgaatgatatcttgatgagagtccattgccattaccatggcaattggaggaagcgtgtgtttgcatgtcttgaaccatggactcttttccttcctgcagatcaccggaggaatccaaatctccagtacctttatctgacgttggattggcagcattatgatcaagcttctttgtattaaggaaacggcctccacaaccccttgcccttctcatagcatgctggtgtcgagactcatgaagatatggctttctaacttttactgctttcttttcaagctctgccttagcacgtgcctgtcttcgcctcataataccattaaactgttttgcatttacataaacaggttcctcttccatttcaaggggcaaaggcatcctggcgtgagtcattccatctggga

SEQ ID NO: 10558 - DNA, 839 bp, Populus trichocarpa
  Predicted polypeptide sequence is orthologous to G2632
ttttttttttttttttttggctaaaatctaaccagagactacttctacttgagtttccttgacagttctatgtacacaggaaaaaggagagggggagagagagagagagagagagaataatgatgcacgcgaagcgttggcagacaaaagaagccaaccacggattcatcatctccttcactctgttcaagccacaagcaagaaaaagaaaaagccaagaatgatttgccgcctggcaatatatattgccaagtgcgtggttgcctgataagagagaggattcaagtttcgctacttgcgtgaattggaccctccaccttggcatccacttaacatgctgggttcactgtgggccaaaaaaccttcgtttggcctggttccccagttgctggcctggacagtcttcgtcctcattttcacctgaacggtctccatcctcattgtcacccaggtaagagccatatgcagaggattgcaagccactgtgtttttgatagtggccacctctatttacatagtcatgagcttcaaaagtgtcatgcacttgggactctcttgcttccttttgaccttcagaggaattccaagtttcaacagagtcagagggcaagagttcagaacctgatgaactccgtgactgagatgcatggaccggaccagaaccattgagcttgccttcggatgtgttctttgaagcatcatcaccagttttcttcgcaaaacgtcctccagaactcctttcccttctcatagcatgccggtgccgagattcatgaagatatggctttctagcttttatcagcttcttgtcaacctctgcttttgcacgttgttctctt

SEQ ID NO: 10559 - DNA, 864 bp, Populus trichocarpa
  Predicted polypeptide sequence is orthologous to G2632
ttttttttttttttttttgaaataaccagtgctacattgaattgcaagtgatcgaacaagacagtttcaattttcaaagttaaactaaagagctgataagactaaaatctatccagactacttctagttgagtttccttgacagttgtgtgtacacaggaaaaagaaaaaaagtgagagaacgagaataatgatgcaagcaacccgttggccgacaaacgaagccaaccacggattcgccatctcttccctctgttcaagccacaagcaagaagatgaaaaaagccaagaatgatttgccgcctggcaatatattgtcaggtgcgtggttgccagataagggaaggattcaagtttctctacttgtgtgaatcaaccctccagtcctggcatccacttagcatgcacggttcactggtgggcagaagacgttttggcctgcttcctcagctgccagcctggatgatcttcatcctcgttttcacgtgaacggtctccgtccttgttttcacccaagtacaggccatatgtagaggattgcaagccatggtggttctgataatggccatctctatttgcatacccataagcttcaaaagtgtcatgcacttgggacgcccttgcttctttttgaccatcagaggatttcaaagtttcaacagagtcagaggagaatggttcagaacctgatgaactccctgactgagatgcacgaagtggaccagaaccattgagctttctttcagatgtgttcttggaagcatcatcaccacttttcttcgcaaaacgtcctccagagctcctttcccttctaatagcatgctggtgccgagattcatgaagatatggctttctagattttatc

SEQ ID NO: 10560 - DNA, 890 bp, Populus trichocarpa
  Predicted polypeptide sequence is orthologous to G2639, G2640
ggttcttgctacccagcaagacaagtatcatttgcgtgtgtgtgagcaagtccacctccatagtcagccacccaccacgtgcttttctttctcttttctcttttcttttcattcctccagtactgtttgctagtaaaattgacgataaaaaaaggtcacatgaaattaattagcaaaaaattattttctttgtctcacttatttaattctacttgaaatatcatttgctttcattcgaactgattttcttcaactctgagatgaattagggctggaattgacagcatttccaccagaggtgaattcagatgccatatttcgttgcgttaaagtaagcgccatggacgatgcagatgatcagttggcatatcaaacggctgttaacattggaggccatgttttcagaggaattctctatgatcaaggtgcagatggccgttacgccagtacaggcggtgagagctcctccagtggagcacaacaacttcttataacagcagcaggaactagcaccacgggaactacaacaaacactagcaatccagctgctggcaatactttgctcgatccatcttctctatatccagctcctctcaatgcttttattgctggtacgcaattcttcgctcccccaaggtcctagctgcattctaaacaaaacctatctatttgtcaaagaactccataaataggtggtcttgttgtagtagaagtttttcatttttcagcatgcatgcactcgaaactgaagtagagagagcatagggattttagaaattagaaatggaaacattgcaggaaggagaatgtggatgtttttttttttgaattttttttcgaatttcattcagattcatgatatgggtttattttatttgatcctatcgatg

SEQ ID NO: 10561 - DNA, 931 bp, Populus trichocarpa
  Predicted polypeptide sequence is orthologous to G2639, G2640
ttttttttttttttttttgggaaaaagaagaagaataataacttagcattgaaatttgcacaaaaacaagaacatgttaagcattgcctctcatcagtcctcattcttccttttttctttttttccttaactcctacttgaatggatgtgtcaaatttacttctcttcttactacattttatcatcatcaaatattttttttgcccaaaagtacatggaaaaaaagagctcgctaatataaaagagagagaaaagacgagaatgacgttgtgtgttttcatgatcttggattcggaaagaattgcgtaccagccatgaaagtgttaagtggggcgggatataaagaggaaggatcaagaaatgaagctgtagtagacgccaccgttacaccaccaccaccaccaccaccagtagctgaaattgtggcagatgttgtggctgtgccagctgcgattaaattgagtggctgtactccaccaccaccaccagaagatgtctcaccaggtgccaagtagttgctttcagggccacgatcataaagaactcctttaaacacatgccctccaatgtttacggcagtttgataagctaacatctcctcgctttcatcaatgccactcactctaacacaacgaaataatgccggagagctcacttctgctgggaaattcccaagttctaaccctgacatgttattagccaagtgagtgcaagcaagagaagaagggcttggattttctctctgtcgtttaggattctctccgcgaatttgcagttgttgctgttgctgctgctggaaaatagttaattgatgctgtctttcacggcgtttagaggcaggaacccaagtgcttttcacatgggtttgacactcaaatcctctactcttacaacaagtcctacacctcatgtgtacacaatctttctttgc

SEQ ID NO: 10562 - DNA, 879 bp, Populus trichocarpa
  Predicted polypeptide sequence is orthologous to G264
ttttttttttttttttttatttaaaccaaatagatagtttcatgtcaagttatattctagatgttaccaattgtaaatttttgaaactaccgaaggtaccaggagaaacctccgcacacctctcgctaagctttaagacaattgtgatgctcatagagagagctgctccatgtttttagcatttcttggcactccgaaacctaaccttctttcatcctgctcatcataagagtttgctcggtaattagaacttgcctcttcattttcataagagcccggtctttcagttaggaactgttcccagaaaccatcattgactctagctggagctgatgcaggcacttgactgttatttgggatctcctgggaggaggataaagttgtgccctcgttacccagattcatgttctgaataactcgcatgtcagaatctttgttactctcgttaaaccttgattctggagatttgacaatttcctgacgtagtggaggcatcctagctaaataaggatttttgttgacttgcaatgcagaagatgccagagttaggttcaattgacaggaaataaggccatcaacttcttcattggaagtcaaattcgcctgcagtgaatgttgtgcttggctcccacttgctggtaagtctcttgggacagcaggattcactttaaatgtatacgatgtcccagtatccgaaagttccaatggtttcaggtgccaatagtaaacctgatgtcctagtaggtccatcttttgggattcccttcagatattttcctttgtgggcttcccccgtcttcattggagctctgcgtactacgtgaaatcaaattaatatctgaacagctggggataattccagcctcaacttatttgaga

SEQ ID NO: 10563 - DNA, 719 bp, Populus trichocarpa
  Predicted polypeptide sequence is orthologous to G2655
ttttttttttttttttttgaggctgaaaacagtaagatcttaaagagaggaaaaaggttgagccgtagaggttaggagagagtattagtacaaactagaacaaaaaaatatgcttgggcaaggcattaaagatggtttgaattgaccaagcatctatgtgtggctcatacacaagatgctctagaaaaactacaaaaagaaaaaggtggagaaaaaagttacaaaatagaggaacagaaacatccaaattagaccaaccagactaagctacactaggaataaaatgggagagacattagtcgcgatgagcctttcagagactgcctaaaaatgcagaaattgccctcatatggtgtgtagagggccaaccacaaaggaaaattaatagtaaactttctaacaattcagcacacactcttcttgaatcctacctagcatctgatacactgctgtagcaatctcatccactgaagtcagcttacaatcatcttctaccttgacacttagagaataaagcacaatttgatcaaccgttgtgacgtttaggtgaagaacagtgaggcgcatgctatgcagcccagaaacaaccttcaagagctgtttcggccgccttttcgatcttattttgaggttggcatgactctctaccatggtcacttctatgtcagctatagtagattgagtcttatgcaacttttcattcttgccaacagagtttc

SEQ ID NO: 10564 - DNA, 864 bp, Populus trichocarpa
  Predicted polypeptide sequence is orthologous to G2655
ttttttttttttttttttcgcatgggcaagacattaaagaaggtttgaattgaccaagcatttatgtatggctcatacacaagatgctctaagataactacaaaaagaaagggtaaaaaaaagttacaaaacaaaggaacagaaacatccaaattagaccaactagagaaagctacactaaggataaaatagcaaagacattagttgcaataagcctttcagagactgccaaaaaatgcagaaattgcccgcatatggtatgtcgaggcaaaaagagggccaatcacaaaggaaaattaatagtaaactttctaacaattcagcatagactcttcttgaatcctacctagcatctgatacacagctgtagcaatctcatccacagaactcagcttacaatcatcttctaccttgacacttagagagtaaagcacaatttgatcaactgttgagacatttaggtgaagaacagtgagccgcatactatgcagagcagaaacaaccttcaagagctgtttcggccgccttttcgatcttattttgaggttcgcatgactctccaccatggtcacttctatgtcagctatagcagattgagacttcatcagtttttcatccttgccagccgagctttcgcaatgaattgagcttgttgtgtactgtggaaatataaagaatttagagaaaggcagtgaagaaacatgttgctgatcatcaccatttggtttttctttcatttctttacaggcaccaagaacttgtaacttttgttcaagctccttgacaaaattaatggcgcctccaataattgaagcttgatcacccctttgaacgtaggactcaggcattaaagatctcagaact

SEQ ID NO: 10565 - DNA, 932 bp, Populus trichocarpa
  Predicted polypeptide sequence is orthologous to G268
ttttttttttttttttgcctgaatatttgtgtatatttctagatcaatatctagtaaagaataaacaatacaaatgctttcaacttgagaaagtagactgtactatggacattgattgtgttttacaacaattacatgacaaatataacggcctctctttttggcatgatgagccagttactacgttctgacatcaggatctgcacccacatggtaagtcctcaaaagacaaggggtgaagtccatgaagctcagtagcccagtggcctaatcgctacaggatcaaaataattctttctccttcaaaatccagcttttcctacccatcttttctccattatctctaagtagttgatctgatatttacaactacctccagaaaaccactgctagcttttagattgcattcattcaaggacgcaaaaggcgcttgtcacaagtcaagatcctgtaacttgcatgaggaccctcagatgtgtcgcgcgaagttgcctgccagcccatggctttagctatctgtagaagttcatccatgacatcaagagagtcacgaatgtatactcgaccaccgggtctaagtatgcgatccatctcgagcatgattgtagacatattacatcttttcctttcaacagaaaagaggccagctgcatgcaataaatcataggttcttgggtatgtatcgaatggttcacaccaatcatgcataactcccaagagcccgcggtcatataaaacaggcaaggtgttggatccgctaacaggaaccacgttcaaaacccagcaatcaaatccttgatcaattaatgcagccgcgaatcctccaaagccagctttcatgtccatcacatttctaagtttaaatttcttcccatgccaagcacggacatagccagctattgtttcggaccaaaacttattttctgccttta

SEQ ID NO: 10566 - DNA, 864 bp, Populus trichocarpa
  Predicted polypeptide sequence is orthologous to G268
ttttttttttttttttttgaatctttaatatattaattatacaaccaattatcaagttcaatctattacactatattcagtactttttaaatatcactaaagctacatccacagcctcgtggtcaaggcaaggcacgtacatagataggatcggaggacacttcttcttgataagcttgcttgcttgcccatataaaattccaaaagccaaaagccactgctggcatgcacacaccttgcttagctacctgctgcagcatacatcattcagatttcagagagagcatacacaactgagacagttgtagcctctcgtggaagctaaaacgaccccgtatacgcctcgtgccgaattcggcacgaggtgaaattagagattagagattgagtgtttgtgtatatttctacatcaaatgttagtaaagaatagataatacagctggttttgacttcagaaggtcttctgctactatagacattgtgttttgcaacaattacaccagacacgcagacagtgggctccccttcttggcaggatgaaccatgttctgatagcaggatcacaacagggcaagtcctcaaacaacaaggggtgaagtcaatgaatctcagccacccacagtcctaatcactgcaaaatcaaaacaatccttcctccttggaaatccagcctttcttagccatctttctccagtgtctctaagtggctaaggagacatcgggttgatctgatcctttacagctacctccagaaatcactgctagcttttagattacatttattcaaggacgcaaaaggcgcttgtcacatgtcaagatcctgtaacttgcatgaggaccctcagatgtgtcacgcacagttgc

SEQ ID NO: 10567 - DNA, 858 bp, Populus trichocarpa
  Predicted polypeptide sequence is orthologous to G2699
ttttttttttttttttttctgaacctgctgtaaatcagatatcatttattaaggaaaaataacagcaatgttgattaagaaagggcgtagctaggtactagcaagttactttcaacttcctgaaacaaaaggacgggggaacaaggtggtggaggaatttgtctcatacaaagactacgtacatttctctctttgccttccatgtgctcatacctagagagcaaatacataggtaaatattaggtcattctcataacactgctgataccctacttgcctgtgcccatttgcagactcttggcaaagagagaggcaattttattttgtcattgcatcttcatctagaccatcttaaatgaagggaaaagaaaaatcagccccatcacaatcttgcccgaaattatctagccacttatgtcacatttctttgtcatttatcatcaagtccagacccaattaatcctgcaaatcaattgggacccaagctgtggcaaaaactgagttgtgacccttccatgtgagcattaacatgtgatcttctcctcttttcatgccccaaccactagcatgctcttctagcaagcatctaacttcaccaattgtgtcttcacagaatggaacactaaaaaatcctgcattcttcatcctttctgatactttaatcccgggttctaacctctctatcctctgaagcccttcaaaactgataatattctcgattttgtgaccaatatcggactcatattcaatcctttggctactatctttaggcaagaaagtttccaaagcatcgaatggtatccatagataattgaagcaagtagtaatcctagatgagagacttggtgcacttaaatc

SEQ ID NO: 10568 - DNA, 847 bp, Populus trichocarpa
  Predicted polypeptide sequence is orthologous to G274
gagctaatactctccctccctcccagctctgcttctttacccccacggtcacactgggacactgaaaccgagttcaagcactgtggagatctagagtgtgtgtgtgtgtgtgtgtgtttaagtaagctctcattgaagagctagctagattcatctttcaggggattcgcccaaacacatcatgggtaacaagcacaactctgcagggttcaaaacacgaagtccattgtctatattcattgttatctgtttgtgctgtttcttttacatcctgggtgcatggcagaagagtggttttggaaaaggagatggcatagctgtacagatgtcgaagcagacggattgtcaaatcttccctgatctgaactttgaaacccatcataatgatgttgagattattgagccttctaagccaaaagccaaagtgtttaaaccatgtgatgtcaagtatactgattatactccttgccaagaacaagatcgagccatgacatttccacgggagaatatgatataccgggaaaggcattgtcctcgtgaagaagaaaaactgcattgtcttattccagcacccaaagggtacacgactccatttccttggccaaaaggccgtgattatgtccattatgctaatgttccgcataaaagcctgactgtggagaaggctgttcagaactgggttcaatttcagggtgatgtattcaaatttcctggaggagggaccatgttccctcaaggtgcagatgcatacattgatgaacttgcatcggtgatccctatagcagatggctctgtcagaacgcactagatactggttgtggggtagccagctggggagcatacctga

SEQ ID NO: 10569 - DNA, 979 bp, Populus trichocarpa
  Predicted polypeptide sequence is orthologous to G274
gactcgaactgaacccgacagccagtctgcatcttcatgcgatccatttgcgcttatctgatctgatctgatctgtttccataccttacctctctccttcaacaagaatggcattgaaaagcagttcagctgatggcagaaccaggagttctatacagatatttatcgttgttgggttatgctgttttttttacatcttgggtgcttggcaaagaagtggctttggcaaggctgacaatcttgccatggagattactaagagtacaggagattgtaatataatcccgaatcttaattttgagacccatcacggtggcgatgctgggtccagtgatgattccgattcaaaacccaaaacttttcagccttgccattctcgttttactgattacactccttgtcaagatcagaagcgtgctatgacttttcctagggaaaacatgatttatcgagagagacactgccctcctcaggaggagaagcttcactgcttgataccagcacctcaaggttacgtcaccccatttccttggcctaagagtcgtgactatgtgccctttgctaatgcaccctataagagtttgactgtcgagaaggctattcagaattgggtccaatacgagggcaatgtatttaggtttcctggtggaggcacccagtttccacaaggagcagataaatatatcgatcagctagcttcggtgttaccatttaccaatgggacagtcagaactgcattggacactggttgtggggttgccagtttgggtgcgtacctctggagcaggaatgtcattaccatgtcatttgctccaagagattcacatgaagcgcaggttcaatttgcccttgaaagaggtgtacctgctgttattggtgtttttggttctgtaaagcttccatatccatccaaagcctttgacatggctcactgctctcgttgcttgattccatgggagctaatgatgggatgtacttg

SEQ ID NO: 10570 - DNA, 944 bp, Populus trichocarpa
  Predicted polypeptide sequence is orthologous to G274
ttttttttttttttttggcaaaatggaataaattgaatattggctgtggttaactaagaaatataatctttgattgtgaaggacgttcttcttgtcatcagtattgcattcgtgaagcttgataatttaactgatcaagccactgagttgtgcatatgctccacatcaacaataacagattaataacttaaatcagaattcttcagttcagcaatttaatcacttgcttggcattgtaattgctggcataattttgccctgaaaacaatgactaccggattattgatcacttgatgtgctgtttcctgtgccaccaacccagtactgtttaaccaccaccagtatcttctcaggtacaaggggaccatcctcatgatccatcatttttgtatcccatctcattcctccagcaattttcttaaccttgttcagaacatcaacctcatctcggaagattacggtcccttcaggacgcaaaatgcggtccatttccagaaggatgtcttccaggttacacttgttctggtacaaactaaatacaccattggcatggataaaatcatacgtccttgggtatgttgagaacccttcacaccagtcatgataaataccaactaaacctctctcgtagataacgcctaaagtattcttagcaatggttggaactacattcatcacccatgattttggggattcaagtgctgctgcaaatcctccaagccctgcattcatatccatgatgttcctgtatcttgtagtgccaatcaacttattgttccttttataagcatttatatgctttttccaaagtttattgtcctcctggaaggattcagctgtgacacccttgacaagtcccttggctactcgaggaggaattgcaaaaagcctctctggaaacttcttaaactccctcctgctacttcatttgcactgtttacttc

SEQ ID NO: 10571 - DNA, 594 bp, Populus trichocarpa
  misc_feature (42)..(42): n is a, c, g, or t
  Predicted polypeptide sequence is orthologous to G274
ttttttttttttttttttgccaagaaagagatttattaatcngggaaaagaatgatgcaattggtaggtgaagctaacttatctacattctataactatctcaaatgaaagagcataactcggtaaacaaacaattctgcagaaacagcattccttggctggctggaaggtagaacaattctgcagaaacagcattccttggctggctggaagctagatgacccatgtgtagtagtaatctgtacgatctgactaggaaaggttgagctcttcctgatacaatcacccccctgatatataatccaaaaacacttgttcactgtgatgaagtgctattgttttcgcctgcaacccagtattgtttgacggtgaacaacactttttctgacggaagcggcccatcctcatgatccaccattttcgcattccatctcattcctcccacaattctcctcaccttgataagcacatcaactttatcacggaatatgactgctccttcaggccttaaaatacgatccatctctagaagaatgtcttccatattgcacttgtctttatacaagctgaaaacaccatttgcatgaataagac

SEQ ID NO: 10572 - DNA, 744 bp, Populus trichocarpa
  Predicted polypeptide sequence is orthologous to G2747
ttttttttttttttttttggacttttaattaatatattatatagcaataagttaagtcactactaaaggaaaaacaatgatggaaatattcctgatatttatctgtatatatgtattatacacagttgaaggatttgtcgaactccacatttcttgcacctctcttccatctcttgctcttcacaatatacccaaaaccgcgtctattaatctaccgacaatatttaaacaatcgacaaaaagaaactcaaagaaggctaaaacttataaattgctagaaacgaaagaaatgggatcttcatcacttgatgtgcaggtgtgatcaaagatccaaatcaaaagataaggaagcctttcctttctttgaaaactcagcttgcattggagcaccagtgggttcccttacttggaaaggaggagggagagaagaggaagccaaacgaggggagagtgaatccaatgtgccatgtctgatcattgtaaccgaagatgacgggtcattttgtgtaggacactccatgtttacaccaaacagcctgagccgcttccccacagtcttaccatgaacaactggcactgagtctatcaccacctggcacatgacttcctccttgttcatgcactgccccaattggaagtgtactcgccggcggccttaagtaatactgcgctgcattgccataactaatgttggacggttgatgataatgatacagaagattatggtgttgatgttgttgataa

SEQ ID NO: 10573 - DNA, 894 bp, Populus trichocarpa
  Predicted polypeptide sequence is orthologous to G2766
ttttttttttttttttttcttttttttttttttttttttttttttttttttttttttttttatttttaaatacaaaacactttaaaaaataataattaccacacttacaaacaccaaacaacaccaaacactctgttgactcactcattgatacattagttgaccaggcaaatctactatccaaatcttggaccatcccgacaagatttgataactatgctctcaattctcaaataccaagaaaacaaaaaaggggaaattaaacagcatttttacatgcatcatttctgattaaactacaagtcaacaatatcactccactatatacagttttgggtttgattccctaacgttacggttgttaaccgaaatttggtaagataactttagcctgcctgagtccctgccttcaaattccttgaatcaaaaacttttttcacatttatgtcgggtcaacgttcatcccatttcagccgaacatcatggggctctaataaacaatctaactttcggttgccttgccgtgaagtgatgatttttcacacacagagcaaaaaattgcccatcgctccaggctcccatttttcacacaatcatggggttgatttttcgcatccacaggtacaattttccatttctttgtggagtttctccacctcattttgaaggcctttgatatgctgcactgcgaaatccagcatgtctgcataacttgtttgcttatccatgttcggaacgagatcttgtagtttcttcagtttcccacttattctggttcttctctccctttcagcaatgcttcttggatgagtggcaaagccacgcttagcacggattttgcaaggaacagagtcttcaggaacatgtagcagcttctccactgtttctatctca

SEQ ID NO: 10574 - DNA, 886 bp, Populus trichocarpa
  Predicted polypeptide sequence is orthologous to G2766
tttttttttttttttttttaaattatctcaaagtagtgataatataatacactagcaacttgataataagaataatgataaaaaaaaaaaacaaaaaataaagtaaaggttcccacatgtttgacaagttgcttgtcacactatacattgcacaagattacaaaacaaaaaggtcacctcaggctcaggttcaggctcaggctcaggctccgtagggtgacgcaacaactagtctttggacatttcccgaacgagccaatctccttcctcgaaatcaaactttcctttcccatattatcctctctctctctctctagatttttaactaccatagttatttttagcagtagcagcctacagtagagtcgtgggaagaagcctgcgcagcacgcatcatgtatcaacaaccgtcgtcgtcttcttcttcaccgcaaaaatccaatctgccaagtgggctaacaaggtatggttcggccccgggttcttttttaacccgagcagttgattcagtcatcggggctgaccgtgaactctctggtcttggatcaactccccttgtgggccgtcaacaacacttctctggggactcaccctccatcacctcggagtcgacctgcaaagtcaactcatccagctgcgatcgaaaagcacccaaaagtggcggcggcggggggttgcagaggtcgtacggtttgaatgagatagcacatggtgctggatctttggtgcggcagaggagctcgcctgctggatttctaagccatctcgccactgaaaatggtaagtatacatacatattttccttaaaataaatacataaataccatcagtctttatctttgtggattggattgatacggtggacaggagtagatagattcttgat

SEQ ID NO: 10575 - DNA, 886 bp, Populus trichocarpa
  Predicted polypeptide sequence is orthologous to G2779
ttttttttttttttttttggatcaaatggatgcttaactgctcatgccgacaaagcagcatcaatacataggatgttaaacaccacaaatcactatagaaggtcaaatttgaaaaaagagagaaagaaattagccctcgaattggacaagtaaatagcaatataatctctctttttttgtactttatttctggacctttttgtgaagtaatgcaaatatcattagcatttctgccacataaatagacatttgatttgcggcaaagggtgatagctagggaacatattcttgtgctttatagcaacaaagagtaattgccaaaaatgcagtcaaatggaccatgtagagtggaagcaagtgatttctccatatctttctcttgaccatttctgtgtctcctgtgcgtcatcagttgaatttgttccctgagccttcttggaagattctgtgagatttttcaggtcattagaacaactggcagcggcaagctccatggagagaaactcaacttgattctgcaatgagtgtacataattgattatctcctctagcataactgccatccccattgacttgtggcatccaggaacaatgtcttgcaagcatcttaatttgttattgattttctctcttcttatcctttctgctatactgtgactgtctgttgcctggcctctcttagctctaacatgaataacttcctttgatttgtccccttctttctccttgtttttgcctttcttacctcttcctaagttattctttttctctgtgatgtttatagaggctgtaggagaaacgttcttggagctgccggttgattgttccattgcttttggcttcttcctttcatggaaaacattttgattcaagctgacagaatgaa

SEQ ID NO: 10576 - DNA, 907 bp, Populus trichocarpa
  Predicted polypeptide sequence is orthologous to G2791
ttttttttttttttttttacataaaaacgtacagtcgatcttcaaacaagaaaggacgatgaaagagagacaagttctaaaagtttaaaagtttaagtagctctagattccaagattatctgcctcagcttgaaaaatgaaaccccatctaaaataatgaaattacatctttactttccgtgctctagaaatgcatcaagtgttcttcagcacttcttgcttgacaacctcattgcagccattgacaatcatgcctttgctgctaagtgtaccggttgcaatattgttatcattggacattggatgggtgtcaatgccagttatgctgctgctgctgctaacaagaccactggtgtagccattgttcttcctctcctcagaagttgtacctgataacgatgccttaacactggatatggcagcagcaagagcaatgggcatgaggcagagacctttgctttgaagatattgcatggccatggtcacatcggattccagtagcttaagtacttcttgctcaaaggcaatctgatcagcagatggagaaatatcaattcctagaccagctgatggagagagcgacaaactattatgaccctcaggttgaccatctgtgaggagaggaatgactgctccggctgcccctaacctgctcatgcttagcaccttgacttggagctgaagaaatttgacatactctatgatctcatcaagcatagatgccttgtcaaccttattggaattaggtacaagttcttgcagattcttcatcctttcagcaattttctctcttcgaagcctttcagctatactatgtgggtcagtggcatggccacgtcgtgctcttacacgagtttttccagttccattgcagccttctactggagcagctgatgtagtctgaggc

SEQ ID NO: 10577 - DNA, 890 bp, Populus trichocarpa
  Predicted polypeptide sequence is orthologous to G2791
ttttttttttttttttttctttaaaatcttaaaatactactgggtggtggtgacgtcatgggagggagatccaaactgggataggaaaaaaaaaaagaaataataatattaaagttgcaaataataaaataaaaaaatgtaacaaaacctaacccctttcttaaaacacaaacaacggcagtaagttgttcttgggacttggacggtcttgttactttgttcttgtttttggtacttggtggtgttgttggggttagcttaagccaaagtctacgtaaatacggcgtcgtgtcatccactaaaacaccagacccttattttagtagactttgaaacggaagatgaatcctacacgtcacacactctctcctccccttttctcactttgacttttttctccctcaacttttttattatttactctaatagtaaatcccgaaagtcagtcaacgccgttagatcacggtttggaaacggaagcagcatctttaacagcgccaccatcacctccaacgttaaccattgtagccgactggacggtcaaaacagacatgctgggtgaggctggcccttcgccgttggattggagcaaagcgtggtggttgttgttgatcgcggggctcctgttgtgacaagtggcggttgagatagcggttgcgagtgagatgggcatcaaacaaagccctttcccttgtaaatactgcatggctgagcccatatcctcttccatcaacttagccacctggtgctctgtcaccgtcaagctgctgtcgttagttctggccgtttggttgccgttagaggtacgggagagggacccaccatcggcactggcctggatacagtcaccaccagcctcagaggacatgtcagcaacaaggggggcaacg

SEQ ID NO: 10578 - DNA, 877 bp, Populus trichocarpa
  Predicted polypeptide sequence is orthologous to G280
ggttccttcgatctccttctcttttagaaaacatttgtctgtttccatggctaccatcactgaagattctactaacccccaacctcctcctccaccaccagcagcggcaccagctccaccccaacaacagtcacagcaacaatcctccgctccccctcagtatcctgagatgattatggcggctattgaggcattgaacgagaaagaagggtcaaacaagacatcaatttcgaaacaaattgagtcaacacaccccgatctgccacctgcacatagcacactcctctcccaccatttgaataagatgaagcaaagtggtcagcttgttttggtcaagaataactacatgaagcctgaccccaacgctcccccgaagagaggcagaggccgccctcccaagcctaagcttccaaccccaccaggaactgtttctggacctcccaggccacgtggccgccctcccaaaccaagggatcctttcgcgcctgtggcttcccctaagaagaagacgacaagtactggaactgggaggccgcgtggtcgtccacctaagaacgctagtacggcggttcccgctgcgagttctggtggtgctccacccagcggtgcgcggagaggaagggggaggccgcctaaggcgaagccagccgtggcacccgtcgctggctgagtggaattagagcaagggagagaggagagataggaatcagtttctttaatcttttttttttcctttttaactttttttcttttaggtagacaagggaactactaattgatgttgtagcttaagctttagcgttcttcttctttttttttttctaagttttgaatttagtttcaatttaaaatgtggtgagcggtattgtaatgttga

SEQ ID NO: 10579 - DNA, 858 bp, Populus trichocarpa
  Predicted polypeptide sequence is orthologous to G280
ttttttttttttttttttaccataaagcaagaaagctcaattataacaaatacaatcatccaattatacaagaagacacgacacagttgcatgcacaaaaatacacacgatgttgccatactaataacacgcaccactgttaacaactaacacacacaattgaccaattctacagacatgttgagacaacagtccgtcgactgctactaccactaatgggaggagattattaattctgaacactcacttcaggcatagttgcggccttcacctttggaggccgaccccttggccttccactacctgccgtcattggaactgctgaggttgtggtagcagttccagtggttattcctcctgtaggtcgtgccatcttgcgtggcctccctcttggctttccacttcttccagtcgcagcctttggcttcactggctttgggggtgcattgggatcctttggtggacgacccctcggtctggcagggggcaggtctgagcccggtgacaatgggtctttcggcttagggggcctaccacgaccacgcctaggaggagcattgggatctggcttcatgtagttgtttttccaaaatactaactctccggtatccttcattcgattgaggtggtgtgagaggagtgcagtgtggccagctggcaagtccccatattttgattcgatgtatttcgatattgacgtcttgttacagccattggcctcattcaatgcttcaatggctgacaaaatcatctcagggtaaggagggagtgatgggggcttattaatctcctcagctgccattaaatttccaacaaaataagagagagaaagtttgaaactttaatgtccaaactctt

SEQ ID NO: 10580 - DNA, 824 bp, Populus trichocarpa
  Predicted polypeptide sequence is orthologous to G280
ttttttttttttttttttctttttttttttttttaacagctaaaatcatccaattatacaagaagacaagacgcagttacatgcacagaaacacacaccactgttaagaactaagaacacgcacaactgcccaattctacggatatgtagaaacaacatagtccatcaattgttattaccactaatggaaggagatgcctaattctgaacactcacttcagtcatagcagcagccttcacctttggaggccgaccccttggccttccactacctgttgtcattggaactgctgaggtagctgtaggtgttccggttattcctccggtgggtcgtgccatcttgcgtggcctccctcttggctttccacttcccgcagtggtagccttcggcttcactggctttggtggtgcatttggatcctttggtggacgacccctcggtctggcgggggccaggtctgcgggtggtgcaagtggatccttgggctttgggggcctaccacgaccacgccttggaggagcattgggatctggcttcatgtagttgtttttcaaaaacattaactctccggtatccgtcattcgattgaggtggtgtgcgaggagagctgtgtggccagccggcaagttcccgtgttttgattcaatgtatttcgatattgatgtcttgttagagccacccgtctcattcaatgctgcaatggctgaccaaatcatctcagggtaaggagggagtgatggaggcttactaatctcctcagctgccattaaattcccaacaaaatcgagaaaaagtttgaaactttaaagtccacgctcttcac

SEQ ID NO: 10581 - DNA, 605 bp, Populus trichocarpa
  Predicted polypeptide sequence is orthologous to G2898
ttttttttttttttttttgccatcaactaacttttaagagggagtagatataggttggaaaaaaatttgcatataaacaataaagaccaaagtaatgcataatgatccagctgtctaatctgcgttgtgatcacctagatgcaattgccaggtagtaatttacacgagaatgataaacaaatggacaatttcagaggaaaggagaacacagaagtggtttgaaagtagatatacatttttccctcatgtactcctagtgaaacaacggttttcaaacacaaccttgaactctactcgtcaaactcagaggcatcctcagggtcttcatcttcaccgctttcctttctcttgatatattctgacgtggctctatcaaactccgccctcttttctgtggctatatcataatatttaaccttttcctcataggtcattgttttccacttttctccacatgccttgccaacctcacgcattgacttgacatctggattctgctcttggaattccttgcggaaatcctctaagaagtaaaagaaagcagttggaggtttcttgggctttttagcatcaaatttcttatttttcttggtcttcgactttgc

SEQ ID NO: 10582 - DNA, 678 bp, Populus trichocarpa
  Predicted polypeptide sequence is orthologous to G2983
ttttttttttttttttcttgaaagtcttccaagcagtgcaatatatcaatttttcttggaacggtggaagaagacacatctcttttcccatttgaaacttaaaatatgaaagagtaggctcaagattggaactaggtgcgtggacttcagtgtccataggttactccttttaacctaaaaggtttgtctgaactctcaacaagttttttttgtagtcaaaacgatcacacacacccacaagagagatcgaataaagagtgacaaagagctttggttccaagtcagaaaatagggtacaaagagacaactacttgcctttcttctttctcgaaacaaagaaagaaagtaaaagcagatcatcgcaatgaaattaacaaaattgaatgagatttattttgtttttcaaaccccttcatcttccttccgggtgcaatgggaaaagctccagagttctatctccctcctctttacatgacctgctttcttctaattcaaagcattcaaatgaccagctcctacactttcttttgtatggactatcctcatctttctccacttctcccctagtatccaaagatataatggtaatgggagatggggttctaggactatggcttaaaccaaggctgtttctcttctgtttttgcctctcgcgggctttgtggttttggaaccagt

SEQ ID NO: 10583 - DNA, 825 bp, Populus trichocarpa
  Predicted polypeptide sequence is orthologous to G2983
gcgccatgggaagcatgaaggtgcatcagttggcacgtggattttgggagcacgaaccctttcttacgctgggtttcaagcgtttacgccctctcgctcccaagctggccaacacagatcatagtgctgcctctttcgatctcaagagcttcattagacccgacagtggccctagaaatcttgcctcttctgacgagaagaaagattcccctcagggggagacgcacccgggagggacacgttggaacccaacgcaagagcagataggtatactagagatgttgtataggggaggaatgagaactcctaatgggcaacaaatagaagatatcactgcacaactaagcagatacggcaagattgaagggaagaatgttttttactggttccaaaatcacaaagccggcgagaggcaaaaacagaagaggaacagccttggtttaagccatagtccgagaaccccatctcccgttaccattatatctttggatactaggggagaggtggaggggagaggaggatagtccatacaaaagaaagtgtaggagctggacctttgagtgcttggaattagaggacagcaggtcatgtagagagaagggagatagaactctcgagcttttcccattgcacccggaaggcagatgaaggggttgtaaagaaataaataaataaatcccattcaactttgttaatttcattgtgatgatctgccttgacgtgcttttctttctttagtttctttctttgtttcaagaaagaagaaaggcattgtctctttgtactctattttctgacttggaaccaaagctccttgtcactctt

SEQ ID NO: 10584 - DNA, 914 bp, Populus trichocarpa
  Predicted polypeptide sequence is orthologous to G2983
tcgaccatgggaagcatgaaggtgcatcagttggcacgtggattttgggagcacgaaccctctcttacgcttggttgcaagcgtttacgccctcttgctcccaagctggccaacacagatcatagtgtaacctctttcgatctcaagagcttcatcagacccgatagcggtcctagaaagcttgcctcctctgacgagaagaaagattcccctcagggggaaacgcacccgggagggacacggtggaacccgacacaagagcagatagggatactagagatgttgtataggggaggaatgagaactcctaatgggcaacaaatagaagatatcacagcacaactaagcagatacggcaagattgaagggaagaacgttttttactggttccaaaaccacaaagcccgcgagaggcaaaaacagaagagaaacagccttggtttaagccatagtcctagaaccccatctcccattaccattatatctttggatactaggggagaagtggagaaagatgaggatagtccatacaaaagaaagtgtaggagctggtcatttgaatgctttgaattagaagaaagcaggtcatgtaaagaggagggagatagaactctggagcttttcccattgcacccggaaggaagatgaaggggtttgaaaaacaaaataaatctcattcaattttgttaatttcattgcgatgatctgcttttactttctttctttgtttcgagaaagaagaaaggcaagtagttgtctctttgtaccctattttctgacttggaaccaaagctctttgtcactctttattcgatctctcttgtgggtgtgtgtgatcgttttgactacaaaaaaaacttgttgagagttcagacaaaccttttaggttaaaaagagtaacctatggacactga

SEQ ID NO: 10585 - DNA, 600 bp, Populus trichocarpa
  Predicted polypeptide sequence is orthologous to G2983
gaccatgggaagcatgaaggtgcatcagttggcacgtggattttgggagcacgaaccctctcttacgcttggttgcaagcgtttacgccctcttgctcccaagctggccaacacagatcatagtgtaacctctttcgatctcaagagcttcatcagacccgatagcggtcctagaaagcttgcctcctctgacgagaagaaagattcccctcagggagaagtggagaaagatgaggatagtccatacaaaagaaagtgtaggagctggtcatttgaatgctttgaattagaagaaagcaggtcatgtaaagaggagggagatagaactctggagcttttcccattgcacccggaaggaagatgaaggggtttgaaaaacaaaataaatctcattcaattttgttaatttcattgcgatgatctgcttttactttctttctttgtttcgagaaagaagaaaggcaagtagttgtctctttgtaccctattttctgacttggaaccaaagctctttgtcactctttaaaaaaaaaaaaaaaaaaaaaaaaaaaaaaaaaaaaaaaaaaaaaaaaaaaaaaaaaaaaagaaaaaaaaaaaaaa

SEQ ID NO: 10586 - DNA, 874 bp, Populus trichocarpa
  Predicted polypeptide sequence is orthologous to G2989, G2990
gtgcagaatttgcaatatactaaaaaactaatctcaattttttatacaaacaaggggataccaaaagtcgagaagggggtaccaaactcgagctatatatttagtccatcgtatgccaaaatttggtgataactttggaaactctaattagtctttaaaaaggaaggcgaaacttcaaaataagtcggttttggggttgaggggtaaccaacagactggattaattcctccacagtcagcacatgaaactttggaggtgaattaagagcaatgttgtcgacccgatgctgaaagatcttccccttgctgtcaagtttgtactcagacaggccatcacctcgtgccgaattcggcacgagggagcagtgcccttggcctttgccttgcacagttgtatccctctaatctatatctaccatcttatctcccacctcccaaaccccatttcccattacctcgtgagacattttggctttctaaacagataaatatcatcatcactgtattcccatcaacttcttcatccttcgtgtgtaaaaattgctctcaattctctacatgactaaaaaagccatggactcaaccacaagcccccaccacatcaccaaatcccctgactcggacacagatactgaaaccccactccaaacccatctcaccaaggccttatcccttacaaatggctcacacaagacccaccaaaatcgccatcttccaccaccaccacaacagcaaaatatggtggtgtcttacaaagaatgccacaaaaaccatgctgcaggtattggtggactagccttggatggctgtggggagtttatgcccaagtcaactgccacccctcaagaccctacctcgttcaaatgtgctgcct

SEQ ID NO: 10587 - DNA, 873 bp, Populus trichocarpa
  Predicted polypeptide sequence is orthologous to G2992
ttttttttttttttttttctttttttttttttttttttttttttttttttttttttaacaaaaaacataatagttatgtaaaaaaagttactgcccttttaactgtcatgcattctccactctatttctctccatgacgacctttaattagtgattagcaatcactgaacggtcatcaacatagctaaagaaactaaaaaacaaaaaaaaaaaaaaaaaaaaaagcaaaaaactttcatgcccactagtcgtctgtctgtcgtctgttttttcttctttatctaaatcaatacaatggaaaaaatccatggggagccataaaaccatgtacacggactttactctcaatctggtacctatcaaagctatcatagttgctcccattgttgttgaagctgcaacctttgttgtcagcaccaactctaccagcttcctcattagcgttaaaaccacacttgtcgctgctattaataccgtaactattattcaacttttctttcctggacctattgttatgcatccaaactttgaaaacatttctagtaaccccgatttcactgcaaaactcttcaacacctctatcattattgcctctcagcaacctccaccccaacttctcagcaaaaaaatacatcttctctctctgttcttgactaaacttggttcttgctctctttttcccatgtgggcttgtcattgcgagactgtaactctgtttctggagctgggtatcatcgagatgaccagaatgaccagagctcaaggacaacagcatgtgaggagcaaaagggtagaaagactgcgggcttggtgatgccggtgatgttgggctaggacttgggcctgaacttgttgaccctgggctttggcttg

SEQ ID NO: 10588 - DNA, 366 bp, Populus trichocarpa
  Predicted polypeptide sequence is orthologous to G2998
ttttttttttttttttttcagtaaaaagaaaaaaacattttatttatatttccacatatcctgctagacccatttcaccatccttgttccacaaaatggaccatcaaaccaaccactaatatctaattattaaagaaaattacaacaccatggaaagcatcatcaagcattatctttgcccttactattgacatgataattagaagagaaaaatataaaaaagtagtaaaaacaactgtaaccctagctaattactagcttggcctaccagaagaagctccaccaccaggaccatacatattccctggatgacggtgctgataatggtgatgtcccatcatcgccatacttgactgcatcccaacc

SEQ ID NO: 10589 - DNA, 946 bp, Populus trichocarpa
  Predicted polypeptide sequence is orthologous to G3021
ttttttttttttttttgtataatttaaaggactacagtaccatattcaatactatattgtaaattttacaataagatgtgaaagaaagaaaaaatcacatttagggataatgaggtacagaacctagaagctcccttttatgtccctcctcacaaaaagttccaggtctagctattttagatataccaaccctaaatattacaacaacaatatttatagactaatcagtagactatattgttgaaaaaattaacacgatgatttctgcaaatatatatgaatactggacctagttaatactgtgagtccactaggcaacgaagaatgttcacctgcatctcaagacttgttatataacttcccatgtcgctaaacaattcatcaacgcccatctcattcccacccggcatgagagatcttagactggccagccggcttccgatctgctcttcctcactttgctctgcagcttctttcttgcttctggccctctttaatctcttgttaatcttgggcttaccattagggcttggggaagctctcttttgagaagttacatttggtgaggaatgattatccgcatcgtttttcagaatgcttgggccatgcattgaaagacgtctcaatgaggcatggtgatggatggaagagtcatgaaatctaccagcattcgtattcttgtgaagcctgcttttcaaggctcgactccaagcaaaccctggggcggacatcaccaatgccatgtctacttcatatctcacactttcgtctagctcagaatcatggccataattgtcatctactagcctgcatgtttttatcttcttcagagctggaaccaaatggctcacgtaattcctaacaaacattgtttgcccctatcagcttggctcaagaggatatacacatctccgtttagcactcatctgttcctccatgcaagaag

SEQ ID NO: 10590 - DNA, 815 bp, Populus trichocarpa
  Predicted polypeptide sequence is orthologous to G3032
ttttttttttttttttttacaaactcccacacacatcactttttactatgtttactcacccataattacatgtttacaaaataacataaattaaaaaaaaaactaacaataatttagatacatattccaacatgtaaaaaaaattacaaaacagacccctaaaaatccaagaattgtagaggaggacttctaggaatataggaacagtggcggcgcgtcttctccacgcgtcgccgctgctgccgcaagcgaagcctaaaagatcggtggatctaggatgttttctcctcctctccctttctgcaccggcgatgataaccaccatcacctacaaaagaagaaaaaaaacacaagtttcggttcttcctccctttttttagatctgctctcttttggcttcactctttcttgtggttcgttgttttttttttgtcttctgcaggtgatagatctggcggttgggtagctacaaggctagctctgggctactgttttggtcgttactgttgaggagactagaggagggtgatggctttgttgtggctgatggtgaaggaaatggcggggatctatgggctgctagatctctggtgaagactgtgctcctgcggctaatgagggagatcgtgggtctgtggccgctgaaactgtggtggagatgggagtggctgtctggtcggtttcgggttggtcaggagagaacagggaaaatggggatgagatgcaaacactgggaaggaacggctaagagagggagatctggtgagggactgtctaggctgaaaggggaggcttcttcgggtgtaggggaagaa

SEQ ID NO: 10591 - DNA, 710 bp, Populus trichocarpa
  Predicted polypeptide sequence is orthologous to G3054
ttttttttttttttttttggtggttcgctaccagaaagtgtttctgaggattggtaattggaattggaaggagtgttgtcattaaggccatcagaattattccaaaaacggtagtcatcttctgtggcccaaacagaattggaatcagaggaatttgaaatccagctatctggaccagtaattggaattacatttacaccagaaaaatccctattgtaatccattttataacttaaaaccaactaaacaaatgatattaaagttgaaaactttgaagatgaaaccctaactggtgatgaagatgaaaaaaacagtacataaaacacgaatcccatgaactaaaattgatagaaatgaagcaaggatgtgaaattagcaaaatttgagaaacggatattttaattaacacaccaaggaccgagtaacacagagcttgacctaaaacaacatccggtgcagaaataactgaaattaaagggttttcaattacctgatcaaaggaggaaacttgacattcaattacctgaattcttgaaatgggtttttagttaacacttctaagactagattcaaaagggttttcaataaaacttgcagcgaaaatgagataaatattgaaatacaagtacagcagcagcaggtaaaacctgaaaattcatggataaatgggttttggatccaggggcttgggacatggaggagaatttagc

SEQ ID NO: 10592 - DNA, 795 bp, Populus trichocarpa
  Predicted polypeptide sequence is orthologous to G3055
ttttttttttttttttttaggagctaaatattaaattgggaaattaatccaaagtggtacaactacaaagacaacagatctccttggatacgagacatccagttatcatacttcactacaaagatcaacactataaatgcagtacaagcttcaaatttccacactggaaactcaaattcatgcataaacactacgggtttgacattccaatgagcaagggatcatcctgaaacttcaagccagtaaacatagacctcttcaatctaagggctgaagcttcccaatctcttcaagtctcaagaaaacaaactctgcacttggccatttaaaccttcttgcacgtgtccttgaacattttaaattctatcagaatgctacacaggaaaaaaaaacctgaccctattcaatgtcatcaatccagtcaccatatatcctactgattttgtctggacccttccatttctgatgagttctttgtccaggcctctgaataagaatagatgatttctgtgacggaactccaaggtgataaacatctgaattaggcacagaagtaactgatgcgaccacagtttctggtggagtttttgaaggcactcctccctgctttgactcaacagggacaaaagcagaatcttttgcatccatctccacaagccctccaccgtaacggtgtaactctcctactccatgagcaaagtgacacttattcccaaatgggcaatatccagtaagttcccacttgttacaaattcttgtcttccaatttgatggcttcacattaactgcattgcc

SEQ ID NO: 10593 - DNA, 508 bp, Populus trichocarpa
  Predicted polypeptide sequence is orthologous to G3060
ggttctctctctctctctctctctctctctgaaccctgccagctttagctgcttctccagaaagaaaacccttatctgggggtgagggtttatgctcctgtttctgtatctcttgtcagattcagggctttaactctttgagttcattacctaattgggattttcgagctcgtttttatttggatctgagatttaaatcgatgatggatacaagaaagagagggagacctgacttcggcactaatggttatggtggattcaagaaatctaagcaagtcgatagttagaagaataagcttgtagtcaagcatttcaatcttttttaattgtcagtactgctggctgtccatttggcgagagctgccactttctccaccatgttcccggtggctacaaggctgtggcccagatggtgaatctgggacctactgttgctttaccgcctgtacctaacagctctgctccgtctgctgttaaaagccggctatgcaaaaaaaaaaaaaaaaaa

SEQ ID NO: 10594 - DNA, 905 bp, Populus trichocarpa
  Predicted polypeptide sequence is orthologous to G3060
ttttttttttttttttttagaatcccaaaatactcaataaccacgccaaataagcaaaggctataacaagagtatgtcctaacacaggaagaagaagaagtagaaagagacaaggtggcaaatgggaggtcacattcccgacttgcgcaattcctcagcaccatgtgcaaaatggcacctatccccaaaagtgcaagatcctttgttaaagttctcacagatcttggtcttgaagttgtttgatccaccagaagagtgcattgcttggttttttatgggaggcccagaggcttgaccgacatttgaaataagctggcgaaccatgtcacttgcttgactgatctgatcaaatgaaccctcgagctctatgctcctctttttagggtctgcctcatgatcccttatggaaagcttggctccagtaacacgacaaatatgcttcgagttaacaccgttttttccaatgatggctccagcaagtgatgcatcaatactgatcttagtagttgcagaggacccaaagctggctgcagcaccatgaccttggtgtggatgctccatgtgtctactcatcctgcctggaattggccccatggcacgaggatcctcatatgatggagcagcagaagccttcccaagctcccactcaccatgggcaaagtggcatttatcaccaaacttgcaaccttcaactgtgttgtatttattgcacaaacgggacttcacagatggaggagaagagcgatcttgataagaaagggttgggacaccttgatttctggatgctggtggaagagctgggctgccaccaacattaagcatctgagacacagctttgaagccaccgggaacataatgcaagaaatggcatccctcaccaaatggacatccagaagtactgaaaa

SEQ ID NO: 10595 - DNA, 939 bp, Populus trichocarpa
  Predicted polypeptide sequence is orthologous to G3060
ttttttttttttttttttcccacaaagaagccctaagttcaacctggcaagatttatcccgagacttcagtaacgatggcagaccaacaaacaaataaacaacaaagagatcataaaaattgcgaaaagaaaaacctagaactcttagagatggcatctgtctatctttgaatcccaaaatacttggtaaccacgccaaacaccaaaggctataacaagagtatgtcctaacacaggaagaagagagacgaggtagtgaaagtgaggtcacattccagacttgcgcaattcctcggcaccgtgtgcaaagtggcacctatccccaaaagtgcaagatcctttgttgaagttctcacagatcttggtcttgaagttatttgatccgccagaagaatgcatcgatgagttcttcatgggaggtccagaggcttgaccgacatttgaaataagctggcgaaccatgtcacttgcttgactgatctgatcaaatgaaccctcaagctctatgttcctctttttagggtctgtttcatgctcccttatggaaagcttggctccagtagcacgacagatatgcttagagttaacaccatttttcccaatgatggctccagcaagtgaagcatcaatactgatcttagtagtagcggatgacccaaagcttgctgcagcaccatgaccttggtgtggatgctccatgtgccgactcatcctgccctgcattggccccatggcacgaggatcatcatatggagcagcagccctgccctgcattggccccatggcacgaggatcatcatatgaagcagcagaagccttcccaagctcccactcaccatgggcaaaatggcatttatcaccgaacttgcaaccctcaactgtgttgtatttattgcacaaacgggacttcacagatggaggagaagagcgatctggaaa

SEQ ID NO: 10596 - DNA, 756 bp, Populus trichocarpa
  Predicted polypeptide sequence is orthologous to G3074
ttttttttttttttttttactggaatatggctaaactaaaacaaagagagttcacataaaacattctcaaactacagctcctactagggctaccccatccttcctgcatcagatagttaagttacacagactatctcacattttcagaaaatctaccactataggaagttgttagagaatggcatcacagaggatgcataaagatgatgacacagaataaaagtagaaattcagaaccagccttttcctagggagaatggacagcgcatatctccgttttccacctagggcatctatgtggttgagccctgctgtttcttctctccttgtctccatgcctattaattgtgttcccaaccactaatcttttctaagagccagctgatagtaagatcagccttcttcatcgtaatcttcctcctcctcgtctaatcttttgctgagctgtgcaagctgaagagggtcaataaccatcttgtccatttcagaaagtgaccaacctggatattcttcatggttagtttcagcagcaggctctactgatgagctgggggctgaggtggtggttgtggttgtggtggcggcggcggcggcggctggtgctgccgcagctggtgctgctgcagcctttgcatcctcactatcattaacctctgcattcagatcaaagtttcgttctggttgattggtagcatcactgactctgttattttccttcactgattccttagactctgagccattgtccatcactac

SEQ ID NO: 10597 - DNA, 863 bp, Populus trichocarpa
  Predicted polypeptide sequence is orthologous to G3074
aaggcgaggacgggggaggggtcgtggacgaggtgctcgaaatatagaaagagagacttctagtcgtgaccttgaatccgaatcctccacaaccattccgcagagtgttaaaaataactcgaatcctgaagtggtgatggacaatggctcagagtcaaaggaatctgtgatggaaaataacatagccagtgatgctgccagtcaagcagaacgaaactttgatcttaatgcagaggttaatgatagtgaggatgcaaaagctgcagcagcaccagctgccgccaccgctgcagccaccgctgcagcagcaccagctgccgccaccgctgcagccaccgctgcagcagcaccagctgccgccaccgctgcagcagcaccagctgccgccaccgctacagcccctagcttatcagcagagcctgctgcagaaactaatcatgaagaatatccaggttggtcactttctgagatggacaagatggctattgacccacttcagcttgcacaactcagcacaagagtagatgaggaggaggaagattatgatgaagaaggatgatcatgctattagctgaggctcttagaaaaagattggtggtcaggatccaattaatgagcgcatggatacaaggagaggaaagaaacagctgggtaagaaccctaggtggagaacggaaatatgctcaatccgttctccaaatagaaacgctgattctgaatctctccttttcttctgtgtgaatctttatgcatcttctgtcatgccattctctaacaacttccagtagtagtagatttgctgacaatatgagattgttagtttgtgtaacttaactatctgatacaggaaggatgggatagcc

SEQ ID NO: 10598 - DNA, 722 bp, Populus trichocarpa
  Predicted polypeptide sequence is orthologous to G309
ttttttttttttttttttattttttttttttttttttttttttaaataaatacaacttttgattcatcctgaaaaacgcagaagattccacccaaaaaacaagaggaaaaaaagacttgaaatgaaaatacctaagggaacagctggcgattttttttttaagaaaaaaaaatgacaaaggaaaagaaaagaatactgctactaattaacaaaaggtgatccagagacaagcggggtaagtgatggggtctcactttaactccggagcagctcagcatatcacacagaaccgcactagggtttggattgtgtggggttcgaaaaggagttgacctaactcggacgagtagactcagtatgttttgactctctaagcagcaccaactaccggttggttggtgttgagccgccaagcaaaggtggctatgagcgggcgtgtgtgccagcccaacatcaaacacccattattctcctccactctgtacccgtctccaccagcaaacagggccaacaacatgctggattgcttaaacgcgttggaaccgagatgaaccggagcaaacccaaccgaacccaaccgagttcgccactgtgtcagggtctcatgcctctcaactcggtcaggcccttcgcatgccacaacattgcaaatctgcttccccaagtacacctctgacattatcttatcttgggtactcacagatccctccagcgaatcaaac

SEQ ID NO: 10599 - DNA, 874 bp, Populus trichocarpa
  Predicted polypeptide sequence is orthologous to G309
gcacacccgtctttggtttttgagcacaccacccccacacccaaaaatctcactctcataatagaaattccctagaaagaagaatgaaaagagaacacccaaatctccatccccaacaaatctcagacccatctactcttgctgcagctgggtattctacttctaccagtgccatggcacctcataacgggaaagctaagatatgggaggaaggagaggggcatcaagcagatggggggatggacgagcttttagctgttttgggttacaaagtaagatcgtcagacatggctgaggttgcccaaaaactcgaacaacttgaagaagtcatgggtcacgcgcaagaagatggtctttcccacctcgcatctgattctgttcattacaatccttccgatctgtctacctggcttgaaagcatgatttcggagttgaacccaaatctcaatttcgacccctctgctgattctttacttgctcctgctgaatcttccaccatcacttctatcgatttctccgaccacaaacatcatcagcaacaaaagctgttcgaggaatcatcatcatcggattatgatctgaaagtcataccaggtaaggctgtcttttctcagacccaaatagactctagagaatctaaacgcttaaaaacagacctataccagacatcctcttcgtcatcattgtcttccgctactacccttggttcttttgggattttcgaccgagtcgactcgtccggtggtcctagttgactcgcaagaaaacggtattcgtctcgtccatctctttatggcctgtgccgaagccgttcaagaagtaactttaccctggcagaagcgctcgtcaaacaaatcggctttttagctgtttc

SEQ ID NO: 10600 - DNA, 811 bp, Populus trichocarpa
  Predicted polypeptide sequence is orthologous to G309
gattagaatgaaagaagcatgaaaagagaacactcaaatctccatcctcaacaacttactaacccatcttctcttgccgcaggtgggtattctcttactagcaccggtactatgacttctaataacgggaaagctaagacgtgggaggaagagaagggacgtcaagcagatggcgggatggatgaacttttagctgttttgggttacaaagtaaagtcatcagacatggctgaggttgcccaaaaacttgaacagcttgaagaagtgatgggtcatgcacaagaagatggtctttcccatcttgcatctgattctgttcactacaatccttccgatctgtctacttggcttgaaagcatgctttctgagttaaacccaaatcaccatttcgatctttctgctgattctttacctgctcctgctgaatcttccaccgtcacttccatcgatttcaccgaccgcaaacatcatcagcaaccaaagctgttcgaggaatcttcatcatcggaatatgatctgaaagtcataccaggtaaggctgtcttctctccaacccagatcgactctagagaatctaaacgcttaaaaacagacctatatcaaacatcctcttcgccatcctcgtcctccacaactctcggttctcttgtggcttcgaccgagtcaactcgcccggtagtcctggttgactcacaagaaaacggtgttcgtctcgtccatctcttaatggcctgtgccgaagccgtccaagaaaacaacttaaatctggcggaagccctcgtcaaacaaatcggctttttagctgtttctc

SEQ ID NO: 10601 - DNA, 851 bp, Populus trichocarpa
  Predicted polypeptide sequence is orthologous to G3111
ttttttttttttttttttggaaagtaagaactgctattccattgaactattcttgatcagattctagtttacaactgaaactaacaaaactgccaagaacacaaccatgttgacgggaaaatgaaaaacaagtgactcatggaatatttagagcaacgaactttctgggagttgttccaacggcttatgaattccaacttctttcactctaaatactcatatttggactctctgatattggaaatcctaatgaatgcagcttaaaatttgactcttctgaaggatttagggatttgacgggctttctacatgcttgtctcctgtgtcttttgcaatctgagtactctcggttaaggggggtgaattctccccacatgcttcatcaccatcagatgcacaaagattatcttgaatggtgtccatcccatggctgtcgtctgatctttgtgaaatcccacgcccggtcaacaaatagttataagaatgggaatcaaaggtctctgtgccatattgagaacggatagctgaactgaacaagggttgcatcacgcacttcttctcgggaaattcacgtaatgatattcgacacatgggacaagtggaatgctgttgcaaccacatgtctatgcaggtcacgtggaaggagtgcccacagtaggggagaatacgcaatatatctttgccatggtattctgcaaggcaaactgtgcactgagcatcttctgaagccgagaaaagcttatcgttgtacttcttggttggaaagctagctataactacaggctcaagaccatgtaaacctcgttccaacatgctaagatcagatctggaagcaatacgaaaagatcgtc

SEQ ID NO: 10602 - DNA, 900 bp, Populus trichocarpa
  Predicted polypeptide sequence is orthologous to G351
gtttgtttcttactctcttcgctttcaaaagaattcaatatcatcaagaatcccaattatggctcttgaagctctgaactctcctacaacagccactcctttcaattatgaagacacatgtgttaaaaggaaacgctccaagagatctcgtagtgagtccccttcaacggaggaagaataccttgctctttgccttatcatgctcgctcgtggcggctccaccacctccactaccacagccaacaaagccagtcataggaaatcctcctctgagtccaccacagccgccgagaacccctcaacctccaccacacctgcaactaccaccaacaccagtggcaggacccatgagtgctctatctgccacaaaactttccctaccggccaggccttaggtgggcacaaacgttgtcattatgaaggtactattggaggcaacaacaacagcagtactagtgctgcaatcaccacctcagacagtggtgctgtcggaggcggcggcgtaagccagagtcaaagtcaaagaagcggtggtggatttgactttgacctgaacttgcccgctttgcctgaatttgaaggtccaagaatcggtcaccaagcactattaagagatcaagaagtggagagtcctttgtcagggaaaaagccaagattaacgctatcgcttcagaaagaaaagaccggcgtggtttctttgtaaaactgaatttttagaattgtagattaggttcaattaggaagattgttggatttctttgttttaaataagcgctattatttgttcttatcttttagggtttgctttgatgatgagttggttctgtaaagagaatttcttcatcgtttgtagccttcctacgctactggacaaaaaaaaaaagaaaaaaaaaaaaaaaa

SEQ ID NO: 10603 - DNA, 669 bp, Populus trichocarpa
  Predicted polypeptide sequence is orthologous to G351
ttcgaatttcaagtattacaactgaaatatccaacttctatgcacaaaaaaattaattaaataaataaaaaagtccaaacaatggaataaatctctaaattgatatcacctaacacagcctaacagaggttctaatttttctactgagcttgggagacttcaaatcttggtggcgtcgaaatacgaagctttttcgctgccggtagagggctcataacctcatcttcaccagatacagagaaacatgaagagaactctggcaaggcaggaatattgaggtcaaattcgttgtggctatgagtgcgagtgttggtagatccagcactttcagaagttgaagtgacaccactcttttcgccgcctcctatgatgccttcatagtgacacctcttgtgaccacccaaggcctgtccagtgggaaaagtcttgtggcagatggagcactcgtgagtcttaccgcttccgttagatacggtttttgttgctgttatggcagaagtagttgtactggaagtagtttggtcttcgccgcctccagcgagttttctgtgacttgccttgtgaccgcctagggcttggtatgaaggaaactccttgttgcatacggaacacttgtaactattttttagctctgaacatgttaatactgttgatggggtgagggacttc

SEQ ID NO: 10604 - DNA, 619 bp, Populus trichocarpa
  Predicted polypeptide sequence is orthologous to G351
gccgccgaaaacccatcaacctccaccacaactaacacaaccaccacgaccaccaatggtaggactcatgagtgctctatctgccacaagactttcctaactggacaggccttaggcggacacaaacgttgtcactatgaaggcacaattggaggcaacaacagcagtagtgctagcgctgcaatcaccacctcagacggtggtgctgttggaggcggtggcgtgatccagagtaaaagtcaaagaagcggtggtgggtttgactttgacctgaacttgcctgctttgcctgaatttgaaggtccaagaatcagtctacaagcactctgcggtgatcaagaagtggaaagtcctttgccagggaaaaagccaagattaatgttttcgcttaagcaagaaaagaccgatatgggttcttcgtaatttgaatttagaatttaagattaggtttaattaggaagattcttggattttcttttcttttcatcactcttctatggtgttgtcttttggtgtttgctttgataatgaattggttctgtatagggattgtcttcattgtttgtagacttcctctgctattctaccattggacattaatttaaaaaaaaaaaaaaaa

SEQ ID NO: 10605 - DNA, 788 bp, Populus trichocarpa
  Predicted polypeptide sequence is orthologous to G354
ttttttttttttttttttgatacctttatctagcttcttatttcatgtatatgaacaaattaacttaatataaatacaagatgtatagcgagtgttcctaaatccaggaagaacgaaaggaaaggggaaaaaacctagctataggtatagtttcatgcgattacacatgtaagatctaaaagaaacaattgaccataggagctgtcgttccgagcttaaacaactccatatcattctcataaggagtcaaattcaaatccaaacacaaaaccctcctgctattagatctcttcacgacaggaactgctttttgatcatcagtgctaggagggttcagaggatccacctggtttcgatcattcaaggcagctctatgtctcctcatgtgaccacccaaagcttgtccaatagcaaactctagtccgcaaatagagcactcgtgcgttttaggctttgctggcgattgagtctcgaagctcccttctcctcccatcaaccttggcttcttgtgacttgcacggtgaccacctagggcttgaaacgatgggaattgcctattgcatgttttgcactcaaaaacacgagcaggagaaatattgctcatggcatgatcaaatgaaggaaaagaatatgattcccttcctttagatagaaacatcaagcaattagccatggttatgctatcaatctctctctcatgcagacctctcttcatggtataagaatatgaacaataagggttttgttatcctttggtttcaaatgtgaaaaggatgttggatttgctc

SEQ ID NO: 10606 - DNA, 589 bp, Populus trichocarpa
  Predicted polypeptide sequence is orthologous to G363
ggagaacattagctaagcgtgcaataagaatgggtattttctcggaaaggtatgccagcctagcatcgttgcctctacatggatcctcattccgatccctagggatagaggcacattcttcagtgcaccaaaactttgcaccaccagtaaggtcactagaaataagcagcagtgcaagatttgatcaaggttatgcaggtctgccagtattcatggaggatgatgaggcagagttgttatggccaggtagttttcgacaggtagctgtgtcagacgatgctcatcaaagttttgtagtcgcaggaagttcaaacatgatttttttgggggcaactccaccagtgaacttagatgattctgcgccagatctcacactaaaactttgagaacattggttgcagtatttatgctccgatattatctcttgtatagcaagttgtgcaatggaccatggctgaacttttatattccctgttaagaatttgtatgtcagtgtataagagcttcacagagattattctggagcttcttcgtttgttatatctatgtgattgatccttttaatttgctgaaaaaaaaaaaaaaaaaa

SEQ ID NO: 10607 - DNA, 885 bp, Populus trichocarpa
  Predicted polypeptide sequence is orthologous to G363
gctcttatacactgacatacattctcagccatggtccattgcacagcttgttatacaagagatgatatcggaacaggaaaactgcaaccaaagtcctgaaagtcttaaagttttagtgtgagatctggggcagaatcgtccgagttcaccgatggagttgcccccaaaaaattcatgttcgagcttcgtgcaagtacaaaactttgatgagcgtcatctgccacagctacctgtcgaaaactacctggccataccaactctgcctcttcatcctccataaatattggcagacccacgtatccatgatcaaatcttgcactgctacttatgtcttgtggccttaatggttgtgcaaaactttggtgaactgaagaatgtgccttgattcccagagatcgaaatgaggatccatgcagaggcaaagatgctaggctggcatacctttccgagaaaatacccattcttattgcacgctttgctaatgtcctttctctcttgtgagcattttggtgtccaccaagtgcttgagagctgaagaatttgcgctgacagtaattgcaagaaaaaactcgtggtattgcttcagctgtagtgcgcgatgcaggatcgttgctactttcgcttgtgcttgacaatgagagtcccatcgagtcccttccccctaactcatcatcattgaagcaaagttttaagtcgagagaaaccgtttctgaaccggattgagttgctatggcatttttgagataagaagagttagtgaggctttcattggagggacctgcagaagtttcttggtttgataagttggaagccacttggctgctaacatcagaaacattttctgatgatgcctcaacttcaagatcaataataggtttcatcttt

SEQ ID NO: 10608 - DNA, 846 bp, Populus trichocarpa
  Predicted polypeptide sequence is orthologous to G385
ttttttttttttttttttttacaaaagaagtctgtctattccaaaagttcttaagatgggaaagagtagaaaagcagaaaccattgtctactagtgggtgtgagcttttcacccactagtgctccaagatacaaacaaaataacaagtggaggagaagtacggagaggtctcacaagcctaaaaaaaccctaacaactaagttaagaagaaggggaaaagtagtagatcaacctcggaatattacaaggggtctggtctatatttgccctttactttgtttggcgaagtcaattcccgaacctctaacatcttttctcactcatggtatgctttggttcttaattattcttgcccaaaacgaaagccacgaggcaaaaaagaattatgtgaggtgcgttcttgacttctcccattcttctatcacccaaaatcgaaaccaactttgagttttttcacaaaatttccctcgtttttccttctctggtaatgaactataaattaaccttcaaagatcatgcagattcgcatgataaggaagccttaatcctctccacagtgcatgcaatcaagttgttaacagttgcaactgagccaagagacagttttgctgtaggaactgaatcaaccagaatctggaacgcgacagttagaagagatcctcctgtagacccagattcatccatgcctactccatgcgctgcggttccatcaggaaaaaatagcaaaccctgatgggagaagtgccacataatctggatccccgccgttagcaccacgttcattgcacaatatcacaggagcatagattcgaaagaggccgtttgatcagtgcactctcttgcaaa

SEQ ID NO: 10609 - DNA, 677 bp, Populus trichocarpa
  Predicted polypeptide sequence is orthologous to G4
gaccgaaccccaaaaatattttacagaagaaaggaaaatacaatttgaccacttgtctctcaaaaaactcccatttacacccctgtgaagcaaaccaccagcatcatcaacctcaagcagcagcatgtgtggcggtgctatcatctctgacttcatacctccgaccaccaccgctcgatcttctcggcggtttgcggagggattcgagtggtttggtatgaagaaacccttagacaacaagaagtactcgaagccagttgttattaatcttgacgatgatttcgaggctgactttcaagagtttaaggatgagtctgatgtcgatgagaattatgatgtctttgttgatgccaagcctttttctttctctgctactgcttctgcccctgctaagaaacgttctgcgcctgttaaatctgctgaattcagtgggcaagctgaaaaatcagcaaagaggaagcgaaagaaccagtatagaggaatccggcagcgcccatggggaaaatgggctgccgagattcgtgaccccaggaaaggggtacgtgtctggctgggaacgttcaataccgcagaggaagctgcaagggcgtatgatgctgaggcgcgtagaattcgtggcaagaaagctaaggtgaactttcctgatgaagctccacttgcttcatcaaagcagtcaa

SEQ ID NO: 10610 - DNA, 888 bp, Populus trichocarpa
  Predicted polypeptide sequence is orthologous to G4
ttttttttttttttttttcacacaacaaaaaagaaaataacataattaatcatcaattgccagtttacaaaaaacatctgaaataacaaaaaaatgaaaagacaagacactgccgtcgccgttacagaggtgccgaggtgacaggaggagctacacaaacatcatcaaagttccaaagattagccacaaggttttcctgtgtggaaccatttggtgccatggattgcccgtccagatagggaatctgataaaacttcatgtaattctcatacgcaattaactcctcggtcagtttctgtacctcgttttcttcctctccagttcccaaatccaccaccaccacctccttattcttcaccttctctagcttctcctccacttccagcttcacttgacccatataaatattactcttcacgttctgattacagcccaccagtcttgttccctcctctgaagcggacccagaatcatcctccccagaagcgacaattggctggccattaaaaccatttgaagagtaggctccaacctgattcataccagatccgtacccaaaatcataaccttttgagaaatgacaagtgggggtttggtacacaggaggcttggtatttgaattttgagaggaggagtaatgttcatcttcgttgggaaaattgactttggctttcttgccgcggattatgcgagcctctctgtcgtaggctcgagctgcttcctcagcagtattgaaggtaccgagccaaacacggactccttttcttgggtcacgaatctcagctgcccatttaccccaaggtcgttgccttatacctctgtatagattcttcctctgcctcttggcattgggcttctccacttgctcatgatcccctgaagcggggt

SEQ ID NO: 10611 - DNA, 847 bp, Populus trichocarpa
  Predicted polypeptide sequence is orthologous to G4
ttttttttttttttttttcctgctattgcttctcccacaccgaggctttaagcatgttcagctgtgttgtactccattcccatctcagataaacaaccattcctacgagcagcaaaatgaaaggaggcaattatcgatgaaactcataatagagtaaaacaataacttgtagagatgaaactcactaacatgtagccttattatttacaaaacctagcaagcacagaaaagttggctcaataaactcccccaaccatggaggggaagtcttcgaagctccacaagtccactgcgtttgtgccatcctgagttgtgtctccattaaggaagctatcaagagaagcctcccagttacccacaagatctggcatctgaaggttcatcaactgattgtcaaaagccagcaactcttcggacagagatttcccattcttctcttcaacaggcactgcattctcagagtatgatttcaacttcttaggattagcatccacaaagacggattcatcaacttctggagttgctgcaagaacagacaagatttcagggccttgttctccccacccaaagtcacaatcaaatgagttgctccccttgtcagaattgaaatacatagaagcattgtcagaaggagtcaagggcgtcaccccagaatctccaatggccgggaaagaattcattaatccaaactggctcacttgtggtttctcttccacaaagcccatattattataatccgtttctgggttgctcaagtaactaaaatcctggcttaaatttgccttcgtaagtcgtttctgtgagttttccttaattggatgcctttgctgaagcacatggagcttca

SEQ ID NO: 10612 - DNA, 890 bp, Populus trichocarpa
  Predicted polypeptide sequence is orthologous to G409
ttttttttttttttttttcgaatacaagagatgaccttcccatacaaactttttaaggaaatttagttacaacaggttctgaaagttccatctagtttaggggaaaaaaaaaaggaaaaaaaaaagggaccccagacacagccaagattacaaacggggcaaagatcatcatcatttccaattacaaccaggagaacccaccccagcaccacagatctgggctggggcgccgtgagtggatttattgctttaatgcataagaagctgcaagtaaacaagaagaataacaaacgatgatatataccaagtgtaacttagtatgaccaggaccaaaaggcatgatcttcaaaacttgcaggcgggtcagagtaatcgtcatcttcaagcttcggaaagacgtatggaggcaataagctcttgctaaagttatcttcttcatcttgtgacaaatctgattgatcgggttcgaaaacatatgaagaatctcctgcctctaagagtgaggaatgcaccccatcagcgtaatgtgggctgtctgaatcaaatatgtcgcttttggctgagctgatatcttcctgcttacaggccactgttgagattttcgacacttcaccctcggaagctgaatcagctatagcccttttaggtggctcttgcgataatgcatctttatcagacaattctgagattcccttctctttctctttgaggagcaacttgtcggtgagaagattaacctcagcttttagtttctccttctccttgaggaggttgtcatagtcagccttaaggctattgtagctagattgcaaaacgtcataatccttttccagctgtttagtcttccatcttgctcggcggttttgaaccatatagcaacctgacgcggc

SEQ ID NO: 10613 - DNA, 861 bp, Populus trichocarpa
  Predicted polypeptide sequence is orthologous to G409
ttttttttttttttttttatttccattacaagaaatgcattaccttcccaaacaaactgcaagctaaattcatttacaatcggttcggaaaagctccatctaactcaaacaaagagtaccccagcaaaaacaagattacaggaggggaaagaccatcatttccaactacaaccagaacccaacaccacatttggattgggattattgcttaatgattaacaagctgtaaacaagaagaaagacacagaaaccttgttatataccaagtgcaacttagtatgaccagcaccaaaaggcatgatcttcaaaacttgctggcgggtcagagtaatcaccatcttcaagctttggaaagacgtacggaggcaaaagactcttgctcaagttatcttcttcatcttgtgataaatccgattggtcgggctcgaagacatgtgaagaatcacctgcctctaagagtgaggaatgtaccccatccgcaaaatgtgggctgtctgaatcaaacatatcacttttggcggagctaatatctttatcagacaattctgagcttcctttctctttctctttaaggagcaactcgttggtgagaagattaacctcagcttttagtttctccttctccttgaagaggttgtcgtagtcagccttaaggccattgtagctagattgcagaacctcataatctttttcaagctgtttcgtcttccatcttgcccggcggttttgaaaccatatggcaacctgccgaggctgcaagccaagatccttcgccagctggattttcctttcgggttcaagcttgttctcaacctcaaaacttctttcaagaaactgaacttgatcaacagtaagtctcct

SEQ ID NO: 10614 - DNA, 946 bp, Populus trichocarpa
  Predicted polypeptide sequence is orthologous to G428
ttttttttttttttttttgggagtagattattcattcaaactatgtaagcattaattgcgaatatacatgatgcaaaatacaattaatcttcctttcttttttatttctaaagatgaacttttcaatgccagcaatgttgcgttgcataatgtacatgaagccaacaggaatatcagtcgtcttctgtaaagaactgcccagaaagattatccataacagcaaattgcaggttctcagatggtttccagtggcgcttacgttgatttataaaccaattattaatttgcttctgatctagtcccgtcgattccgccaatgctatcttatcagcttcctggaaagatgattaagcaagcaaattatcgtcttaccagcgttgaactttggaaaacaattaaaatcctgcctgcacaaattcatagcatttacatatatatatatagctaccagcatcaaatgaaacatctacatccggcccatctgtaactcgtttataagaatcaaaagacataatgctacccttctcagtttcacacctgaaaataatttcgtgcgttctatgatatcctatgcatcggaaatcaggacttgcatatttttaaaaaaactaaaatagatgcagcctcaaggagagagagagatacacacagttggatatggccatttatagtgagcatcccaccatccaagtagggtttgcctagcttccttcggtagctttcctttcttttttttctttgagaactccagcttcagcgtaccaatatgacttccaaacctgcggagaagtttatctttaagctctcggtcttcaccacttggttgagcttcatgcatatccaactcccctccacttaactcctcatctgatgatggcgcaccttcatcagagatgcttctgatggaggcaccagtgcagagattacgaagctgcatttcaatctt

SEQ ID NO: 10615 - DNA, 901 bp, Populus trichocarpa
  Predicted polypeptide sequence is orthologous to G435
ttttttttttttttttttattcaagaagaaactttgatagattaatactagtgaggctatcatagatcagtcaagagatcaatctgtttttctagcagctacagttcgtattgatctgttgaacaaagtatagacaagaaccttctaccaattagagaccaccattccccacaatagcaggagcagctatatattgggctaattttggcccatcaattttgacgcaaagatcaaaatgccaatccgtacttgctgcaccctataaaagggcactcgaagattatcctttctatccacgtcttgagttctaaatttctaatcttcagaaacaccgaaagacatgaattcccatttacaccaccagtcacaaagccaaggcaaccgacctctcaaacccagaaagaaaaggcttgctagagaccagcttaacctcctggaaacaagtttcaatgctaaccagaagctcaaagcagagcacaagactgagcttgcccgccaactaggcgtgccaccaaaacaagttgcaatatggtatcaaaatagaagagccaggcacaaaaatgatgccatagagcatgactacatgaacatccagctagagctaggtaatgtattggcagaaaacatcaggctcgagaaacaagtcagcatgcttaaatttgagctgaacaaggttcaacaaatgatactttttggaccaacctcatctgctgcaactctcccttcagtgtcaggatctagtgatgagcaggcaaactcaagttctcctggaaacatgatctgtaattggggagacgctggaaatgatgacatatttcctgtagaagagctatatacttgtttgataggctctgacactcagttatgggctcttaactgaaccagcgaatcctcaatcatg

SEQ ID NO: 10616 - DNA, 897 bp, Populus trichocarpa
  Predicted polypeptide sequence is orthologous to G435
ttttttttttttttttttgcgaaaaagggatcagcttctcattaactgtacgaacaaattaattacagagtgcataaatacaagttcttcatctctgtcacttcaaaactggtactttgagattatcttgacctcactgatatacagttatctaactagctaagcatacagtatctgagtttgaactttacttgatagatattctgatacgaacttacaggactaacaatacacaaaaacatggcaagaaattaactaatctttacatccttgataattactcttattataattcatctctgctttaatttcaatctgtgtaatgttcccagttccttaccttgccttactttcgaagaaaattaagagaacaattgatggtttggaagtaacatcaagggccactaatcataattaataacaagtcagtctctccaacactcaagacaccatcaatcataggcagtatatatatatatatatatatatatatatatatatatatatatattagatatccacaacaaagtagactccaatatttgtgaaattaacgtctcatacttaatttgttggtgagctatcacatgaactaggtccacttaagagtttctccactcatggtgccgatcagcacttgattctgatgagtcgttatattatgacagatgacatttgttgccgcacctaattaattaaccccaagttgacccaccagcgccatacaaacaagcatagagctcttcaagttacaagacctcaccattcgcttcctcgtgcaagctagagctgcctccctcatcacaagaggagttagaagaaacattaacaggaggttgagctggtccttggttcaagtggaacaccatttgttgagccctcctcaactcctcttga

SEQ ID NO: 10617 - DNA, 332 bp, Populus trichocarpa
  Predicted polypeptide sequence is orthologous to G450
ttttttttttttttttttacaaatgtctagatctttgatttctatatacgtacgatcaaatgaaaatacagacacatttcttaagaaataacagcagcaacaacaataataataataataaaaaatatagtaaagacatgcacgaaacaccactactgatccttcaatggatgttgagcaagtgccttgtctgctagtcttcatatatggatgcaaggctaaaaggagggaatccagcagggccggaacctgaatacattgagtacataagattcaggttctgctcttgcatttctccattgctcttggtgcaagtccaatggcttcagatc

SEQ ID NO: 10618 - DNA, 929 bp, Populus trichocarpa
  Predicted polypeptide sequence is orthologous to G450
ttttttttttttttttgggtaaattattacgcaagccattagtaataaacaagccagacaacagggggttaagttcttgcttcttgtccattacaaatgtctagatctttgatatctatatacgatcaaacgaaaatacagacacatctcctcaaaaataataataataaaaaaaagtacagacagatccaggaaacaccactactgctccacccacgttgcacaagtgccttgtctcctggtcttcatggatacaaggctgaaaagagggagttcagtagggaagctaaataaattgagtatacaaggttcaggttctgctcttgcatttctccatggctcttggtgcaagtccaatggcttcagatcctttcatgatgcgcaggcgcttgcatgaattgacaaacatctcccatggaacatcacccacgagcatccaatcaccatccttgtcttcgtaggatggcacatactcggaactattaagtagatccatcaacttgctctcattcataaagtctatcattccctgggctccataattacccatggtgaaggaactgaacattttggccaaggcatcagataattcttggtagctcctgtacatcttcaagtccaccttgcgaagatagggtgcaccatccatgcagaccttcacaaatgctgcactgctgccgccagtgcttgccttctcgccttcctcactggcgttcttctgagccataacgttcttcctgtaagatcgaactggtggccaacctacaacttgtgccttggccggtggcttagcagggtccttgatggtacagcagggagggtgggtcttgtcctttgaagtaatattcttgatattctcattcagatccatgacaccctctttagcctgaagattaagcttcaagtcaacagtctcagcaaaccctctt

SEQ ID NO: 10619 - DNA, 895 bp, Populus trichocarpa
  Predicted polypeptide sequence is orthologous to G450
ttttttttttttttttttacaactaacaataggtgattattacacaagccagccaatcgggggttaagttttttgcttcttgtccattacaaatgtctagatctttgatatctatatacgatcaaatgaaaatacagacacatttcttaagaaataacagcagcaatattaataataataataaaaaaaaaaaaagagtaaagacatgcacatccaaagaaacaccactactgatccatccatgttgcgcaagtgccttgtctgctagtcttcatatatggatgcaaggctaaaaagggggaatccagcagggaacctgaatacattgagtacataagattcaggttctgctcttgcatttctccattgctcttggtgcaagtccaatggcttcagatcctttcattatgcgcaggcgcttgcatgaatcaacaaacatctcccatggaacatcacccacaagcatccaatcaccatccttgtcttcataggatggcacatactcggaactgttaagtagatccatcagcttgctttcattcataaagtctatcattccttgggctccataattacccatggtgaaggaactgaacattttggccaaggcatcagataattcttggtagctcttgtacatcttcaagtccaccttgcgaagatagggtgcaccatccatgcaaaccttcacaaatgctgcactgcttccgccagtgcttgccttatcaccttcctcactggcgttcttctgagtcaaaacgttcttcctgtaagatctaagtggtggccaacctacaacttgtgccctgaaaccttcctcactggcgttcttctgagccaaaacgttcttcctgtaagatctaactggtggccaacctacaacttgtgccttggc

SEQ ID NO: 10620 - DNA, 819 bp, Populus trichocarpa
  Predicted polypeptide sequence is orthologous to G450
ttttttttttttttttttatttaagagctatatattatcgttcttgtccatgataaatattaaggatcaagtagcatctcgcaaaattaacattatttaacaaaccacgtacaattaatattaatgcagaaacaccctcaacgaagagcctgctcaatccatccagcgcgcttttaccatcttaatttttggtccctgcatgcgaccctcgggatcgaaggagcaggctgtacgtggtgctcactacttgaagcttctgttcttgcatttctccatggctcttggtgcaagtccagtcgcctccgttcctttcattattcgcagccgcttgcatgattcaacaaacatgtcccatgggacatctccgacgagcatccagtcaccgtccttatcttcataagttggaacatagtcggtgccattaagaagatctatgagcttgctttcattcaggaaatctttcattccatgggatccacagttgcctatggtgaaggaactgaacattttgcccaaggcatcagagagctcgtggtaggtcttgtacatcttcaggtccactttacggaggtaaggtgcgccatccatgctaaccttcacaaaggttgcattgcccccaggaaccttgtcagtactctcctgatcggtgctgcttttttggacagctaacatgttctttcggaaagatctgactggaggccaacccacaacctgtgccttagctggaggttttgctggatcagtggccagaaggttcttctccctttgagtcttcccatgatttggatcaatacccccctccttggaagaaagattgac

SEQ ID NO: 10621 - DNA, 824 bp, Populus trichocarpa
  Predicted polypeptide sequence is orthologous to G450
ttttttttttttttttttcttttttttttttttttttttttttttttttttaagcaagccattctgataataaacattacacatgatcaaacataacaaaagaagttttataaacatcttcttctattattacttcatgctcctagctagctagttaacaaatcccttcaaatatatttcctcatatacttgaaacttactatgtatgtgaaaaagaaaaaactaaaaaaaaaaaaaaacaaaacaaaacatggtacataaacatccaaacttcaaagctcaaatccctttttagcctgtcgttccttttctctggggacgattggatcagctgaccaaattgactgggaaaaaagcacttcaaattctgttcttgcacttctctacggctctcggggcaagtccaatagcctcaaaccctttcataatcctcaagcgcttgcatgaatccacaaacatttcccatggaacatctcctacaagcatccaatctccatccttgtcttcataagttggcacataatcggaaccattcaagaaatctatcaatttgctttcattcatgaaatctttcattccttgggagccacagttaccaatggtgaaggagctgaacattttgcctaaagcgtcaaaaagttcttggtagctcttgtataatttcaagtccacttttcgtaaatacggagcaccatccatgctaaccttaacaaaagccacaccggtgccactgctaccggatttttcaccgttgtcattgctgttcttctgtacagccatgacattcttacggaatgatctaatgggtggccaacccacaactt

SEQ ID NO: 10622 - DNA, 502 bp, Populus trichocarpa
  Predicted polypeptide sequence is orthologous to G451
ttttttttttttttttttggagaatacttgtgatctgatgtagaactctttgtacaattgcattcaagaagcaaatttgccaactatacatgcagatctgtgatatcctaacaaatccttgtaaaatcttctattacatgcaatcccacaaaggaaaaatccagatccttttttttttctttctgggtgataaaattgatccatatttgatatttcttctcggagaacccaggctaaaagtgcaactcttccctttctctttctgatctcttcttcatcttttgttaggggcctcctgaattgcatgtgtgaagctttacacagcacaacccaaacctctagcttctgactctttcatgattctcagcctcttacatgaattgatgaacatatcccatggaacatctccaaccaacatccaatctccatctttgtcttcatatgttggtacatgttctgatccattatacccttccctctccgaatactcaccaactttggc

SEQ ID NO: 10623 - DNA, 809 bp, Populus trichocarpa
  Predicted polypeptide sequence is orthologous to G451
agccagagaaaccatcaactactcctagtgttaggagtaataagagagcctcgccagaaatatcagaggagtccaggtccaagggcagttctagtgtgtcctccaatgtcgaaaatggtgaaagagacagtgcccctcctgccaaggcacaagtagtgggatggccaccaatccgatcttataggaaaaattgcttgcaaccaaagaaaaatgatcaagttgatggtgctggcatgtacgtaaaagtgagcgtggatggagctccttatctcaggaagattgatcttaaggtgtacaagagctacccagagctcctcaaagccttggagaatatgttcaagcttaccattggtgaatactcagagaatgaagggtacaacggatctgaatttgctcctacttacgaagataaagatggagactggatgctagttggcgacgttccatgggacatgtttatctcctcctgcaagaggctgagaattatgaaaggatcagaagctagaggattgggctgttgataaaacaaaaaacaaaacttgaaacctgtcaacaaaaggagatatggtgatttaggggaagagtaatttggctttggatatattctccgagagattaggtctcttaggaacagaaacaagttgatcagatcttctttttttggcttcggttctccctccttggttttggtttccaagatctggatatgtatcaattaaactatagagacagaaagatcacacttttttatctgaattatatataaacgagcgagtctccaatattcagtgcgaaaaaaaaaaaaaaaa

SEQ ID NO: 10624 - DNA, 772 bp, Populus trichocarpa
  misc_feature (80)..(80): n is a, c, g, or t
  Predicted polypeptide sequence is orthologous to G451
ttttttttttttttttttaaagcccttaaaaacagacttttgtatttagctttagcggtgtccttaaaagattacatggnaaaaacatggacgaccctgtcttaatttccatatgtttcttttctgttttgattttacataattgcatttgaagcaataataacttcctgtatccagttttggtttggtgagattacaaggaccaacaaaatgacaccatagatgtccaaaccaccagatatctcgctgccacaccctacgatatatagaaaccgtaacttcactctgatttttcctgtttcctgtctaaaacttccagccatctgtagaaaacccagtcaagagagagacccatatttttatttgagttttcttcctggagaacccaagctgaaagattttctcaagggatgaatcttctcttctccctgatcctgtgggttaacatggcctgtgggtttttcatacaccacaacccaaattaacctgttgcttctgatcctttaatgattctcaatttcttacaggatgacaggaacatactgcaaataagaataaaccttgtgagaaaatttatcacataacatacagaaatggattcaaatgatcttgagagagagaggcatgcagaacttactcccatggaacatctccaatcagcatccagtcaccatctttgtcctcataagtaggtgcatattctgatcctttgtagccttccctttcagagtactcacctggcatagttacagatttcatcatcagaataata

SEQ ID NO: 10625 - DNA, 917 bp, Populus trichocarpa
  Predicted polypeptide sequence is orthologous to G489, G714
gcagctttcgtttccaatcttaggttcttgatcttgcaagcagagagtacaagctctgcagaagggaaagaggcattaagttgcatattgttgcatttagttggatcagaatggagcaagggcatggacagccccctgctatagtcagtagtacatctcaactgcaatatggaacaagtccgtatcagcctaaccaaatgcttgctgcctcaaatcctggatcagttactggtcagcccgtgggagctcagcttgcacagcaccaacttgcctatcagcagatccaccaacaacaggaacagcaactccagcaacaacttcagtctttttgggcaaatcagtataaagaaattgacaaagttactgacttcaaaaatcatagccttcccttggctaggatcaagaagatcatgaaggctgatgaggatgtgaggatgatatcagctgaggcaccagttatattttccagagcatgtgaaatgtttattttagagttgacattgcggtcttggaatcacacggaggagaacaagagaaggacactgcagaagaatgatattgctgcagcaatcactaggactgacatctttgatttcctggttgacattgtgcctagggaggatctgaaagatgaagtgctagcatcaatcccaagaggaacaatgcctgtcggaggacctgttgatgcactctcttactgctatatgccacctccgcatgcacctcaggttggagctcctgggatgataatgggcaagcatgtgatggacccagctatgtacgcccagcagtctcacccctatatggcacagcatatgtggccacaaggatcagagcaacagcagtcgccctcagatcattagtaactttagaattaatggaaatatccctcctgaaaagtgcagtcaagaatggag

SEQ ID NO: 10626 - DNA, 869 bp, Populus trichocarpa
  Predicted polypeptide sequence is orthologous to G489, G714
ttttttttttttttttttcttttttttttttttttttttaaaaaaaccatgatatttttacatgccaaaaggttaccgtttatccaattatccacaatagctgaactcgcatccttgacaggattggaaatgatgaaatttgaagaggcaataaaaacctgttagcaactgacatgttatggcttgcatacaagtaaaaaccaatcaacccctagcttttcaaccttaaattcacactatccaacatgtttcaactacagctactgcacagcctgctcaggaatcttcaggtggctgctgtgtttgctgtggccaaatctgctgtggtacataagggcgagactgttggccataaaaagcttgatccaccacaggctttcctacagtcatccccggcgcaaagacctggggtgcaagctgaggtggcatgtaatagtaaggaagagcatcagctggacctcctacaggaagactccctctcgggactgatgctaacacctcatctttcaaatcctctcttgggacaatatcaaccagaaaatcaaaaatatcagttcttgtgatagctgcagcaatgtcattcttttggagtgttctccttttgttctcctctgtatgattccaagatcgcaaggtcagttctaaaataaacatctcacaggccctggcaaatatgatgggagcttcagctgatatcatccttacatcttcatctgccttcataatcttcttaatcctagccaaaggcaggctatggttcttaaaatcagtagtctgctcaatttcttgatactgatttgcccagaaagtttgaagttgttgctgcaactgctgctgctgttgctggtggatgtgctggtaagcaagtt

SEQ ID NO: 10627 - DNA, 952 bp, Populus trichocarpa
  Predicted polypeptide sequence is orthologous to G489, G714
ttttttttttttttttttgacagtgagcaaccatagttcacataccataacagaaggatgatgttcatggctcatcaattatcacgtacatataggaaagggaaaaaaacaacaacaaagtctggtcattacatgacaccattactgaaattttcaacatcgactgtcatctccatatatggtttttactagaaaaggagtatgatatgcgtactaaaatctggtagaaaggcaagaaatattggcactatcagttacatgaaagcattcctgtacaacatactcatctgatcaccctggtctcggtcatcaaacacaatccagcggtagataagttaaagtgagcttacacttctgaacttccatgctccagttactactgatctgagggtgactgctgctgctctggtccctgtggccacatatgctgtgccatatagggatgagattgctgggcatacatggctgggtctgtcacaggcttgcccattatcatcccaggagtcccaacctgaggtgcatgtggatgtggcatatagcagtaagggagtgcatcaacaggccctccaacaggcattgttcctcttgggattgatgcaagcacttcatctttcatatcctccctaggtacaatgtcaaccaggaaatcaaagatatcagtcctagtgatagctgcagcaatatcattcttctgtagtgtcctcctcttgttctcctccgtgtgattccaagactgcaaggtcaactctaaaataaacatttcacaagccctggcgaatataactggtgcctcagctgatatcatcttgacatcctcatcagccttcatgatcttcttgatccttgccaagggaagactatgatttttgaaatcagtaactttgtctatttctttatactgatttgtccaaaaagactggcgttgttgctggagttgctgttgctgttgctg

SEQ ID NO: 10628 - DNA, 920 bp, Populus trichocarpa
  Predicted polypeptide sequence is orthologous to G519
gtatgaatccaattataaccgcaacaacaacagcaacagcaacaaggaaactaccataaatctacacatgctactgccctatacacacccccaaaatctaaatccatcagggaccgtctgatcacccctacttactccaattactacataacactagcactcgcacacgcacactcacagacttcagtctcgtgttaccgtgcgatttgcccttaacacaatcaattcccattctgacttcaaaacggcttctgcaggtgcataaatatatcctgaagcggcgacatctgattatccccctgcaactgagacgcaaatggaatatccattgtggcatccaggtaattgtaaggattatcgagggcatttacgtttccccattccttacacctaggctcactctgcacctcgcacgtgaattccggcgacaccacatgctccgagcagctcgaatccgtgtgcatcctcggcacggagtctgacgtgtcaaagtacatgtaatcattcaccgttcctgtcgccgaggacggagcttgtggtggcggcagcaaaacaacctgcttcttctcatcctcctcaatctccgtcggattcgctttcttgacgctaagatgctgttcttgcttctcaactgtacctttcttgttgtatatgcgacagagtacccaatcatccagccttaagctgttcttcttgcgagccgagcgatccacgtcggctagacgatactcgtgcataatccagttcgttttctctcccttaggagctttccccgcgtaaaataccaaagctttcttgattccaactgtcttcggctgcccaatcggcttgtcggctcccgtggctttccagtagcccctccctgcagcacgattcggtctcgatccgttagggtacttcctgtctctcggggtaaaaaa

SEQ ID NO: 10629 - DNA, 760 bp, Populus trichocarpa
  Predicted polypeptide sequence is orthologous to G519
ttttttttttttttttttggcactttagactttcttgaatgtcactaatttttaattaatgagaaacaaattcgtgtccaatccttacaagaatggttacaattacatattaacatgagaaatgctgattaatccaaccatgttctgtcacccttgatcaatcaccagcttcttataatacgtcccagtccaccctataccttctcctccttcccatgtcagatttggacactggcactggcaaaaaggggtttgaatccataccgcgatcgattgaaaatctcaagttaacactcttccctgtaatctggctcttgaaagtggctgtgtagccctgggtttcgtccatgatatatatgtatatataaaaaaatattttctgacactgatcaatcccccaagatttcccacaactgttaaactacatctgcagactccagacaaagattgtcctgggccacatgcaagaatacaacaatgttctatactatttctacctatgaaactaaaatgcaatggccactgggcacacatcaagaaccctattcttttttcttctttcttttctgtgagtaaaatcaaaatggcttctgtaaatacatgaacatgtcctgcaaaggtgagagctggtccaattggaactgatcttgtgaagcaaaagggtaatcttggaagccatcatcaatgtaattgaagttgaaatcgaaggcattatctagctgatcattccattttggctgactctgaacctccttctcgc

SEQ ID NO: 10630 - DNA, 892 bp, Populus trichocarpa
  Predicted polypeptide sequence is orthologous to G525
ttttttttttttttttttggcatagataattcataagataatttcttacaatacatacaacattgttcactgtctttcaatttatcaatttgattcaagaaatctatgcacaaacccacattttaatttcaaaataagtaataacagtaactgacgctcttctttttcttgatcttcttcaacttgaggttcaccttctagtactgtttttcaatagttccagaaacaatcaaggtccattgattggactaatgtagaaggtggtgcctcttgttcatcaaatgacctttttcccgcttcaagatttgatatgacagaagagatttcattgttcatatctgcagcgctatcttgtgagacactggccatgtccctttcaagcttggaactttgctgcttcatgtttgagccttggttctcaatcaaggcttttaaaactgagcggtcttgaattgaaacagaacctggatattgcaaatttcctgatgctgcgacagcctggggagagtagaatgaattcagaagtgggattcgaggaaaaacctctgaagggttcgaagaaactgcaaaaagatgattgttgaagctatcagttgtgtcttgttggtttctttgatcatcactgagattggagaagcagggcacgtaggccgactcggccaccggcttaatcttgccattggagggtgaagaatccgtcaatggtggcagaccataagggctaaattcattaccaaaagaacctagtctcactagacctgaaatataggtcttctttccagccgagctcttttgaaacaccctgccaatcacccattcattcttggcagttttggggagattgtgggcagagaatttaccctctaatctgtattcatgcatgacccagttg

SEQ ID NO: 10631 - DNA, 574 bp, Populus trichocarpa
  Predicted polypeptide sequence is orthologous to G559
ttttttttttttttttttaagcttagaattttgaatcaacaaatcgccatcaaaggcccatgattgcatcaaggttctacataaactataacatgttaaatgcttaagctataaactcaatcttcaaggaaactagaatatagaacccgcctaaattaggtatgaatgtaatgtatctaaaagactggagataaaaggtaactgtcctatgtgacaacagattgtaactaggatgtaaacaacagtagacagaacatgctgtagttggtctgatgatcatgctattctcagtcctttgatgaagaggaattatcctcagatgaattatctttccggcttgaagaagccattgatcctctcatttgcaaatccccaccttgtttctgctgctgctgaagttgttgctgttgaagctgatgcagctggaactgctgctgctgctgcttctgagaatgaatttggagttgttgaaactgttgtgcagctaagaaagtatgcattgcttgattattgggatataattgctggcctcctccaaaagatgcatagtttggcacttgaccagtcagtaccc

SEQ ID NO: 10632 - DNA, 627 bp, Populus trichocarpa
  Predicted polypeptide sequence is orthologous to G559
ttttttttttttttttttagaaacagaggtgaccaagcacataaacatcaataagaacttgcatgtgtaaacacccatatcggacaggaagtagagtttgaagggttttggtgaggtacaactgaggacaaacctatgaatttcgaatcaacaaatcgccaacaaaggcccatgattgtaataaaggttctacatagactataccatattaaatactttaagcaaactagaatatagagctgcctaaaagaaatgtaaggtagaaatgtaaggtaatgtatattagaaggactggagataaaaggaagggaaaatatcctatgtgacaacagattgcaactaggatgtaaacaacagtagagaccattaagtagctgccttctctttttcaatccttcgatgaagaggaattagcctcagatccattatctttctggcttgaagaagtcaatgatcctctcattttcaaatccccaccttgttgctgctgctgttgctcctgctgctgttgaagttgttgctgctgaagctgatgtagctggaactgttgctgttgctgctgctgctgctgctgctgcttctgggaatgaatttggagctgttgaaactgttgtgcagctaagaaac

SEQ ID NO: 10633 - DNA, 916 bp, Populus trichocarpa
  Predicted polypeptide sequence is orthologous to G562
ttttttttttttttttttggcaagagcatgtcttgtatagaagcacgatcttctcgagctcatatcaaagagtgtccacgtcactatttgatacaattgcacaaacagaaatatttataaatcactagttcccaaaccttccctgaatgagtttctaattctcttcaatgtacattacctttcaatggccatcccagcactgaatattgataaaaacgcatcagttctgccatgagagagctaccttaacatgttaaaattaagagtctcgaggatcggcgccaatcctatttagatattctatcaacagctaaactattaaccgtaattttgggcttgtaattatgccaaaactacatggttgctttgaaatataagatgagggactgcaagcaaactactttcatcagccagcagccacagcatcagctctggggcttgcatccatgagttgatgtagcttggcaccagagttggagcttcgctgctcatcaatgttgtttaaaattatttcttgcgtgggtcctagttgcgcattcttgagtttctcctgctaattgaaccactcgttaatgctgcattttcaagccttagtttctgcgatttctctgtaaactgatctatttctgatttgagtgtcatgttcactgtagtcaacgtttctactttgtgtgcgagttcttcagcctcggcctgcttccttaatcttgaccttctagcagattctctgtttgattgcttcctcctctctcgtttcagctcccggtcattcggtgaccaggcttcagaaggcagcatggcaccaggttgaggaatagttgcaggatttgtcttagcaacattcacactaggagggtttctgagctccaatgctttggtcataccaggatcaacaactgcacccaaaaccttgtca

SEQ ID NO: 10634 - DNA, 893 bp, Populus trichocarpa
  Predicted polypeptide sequence is orthologous to G568, G580
tcgcatggcctcctgatccgtgtttccttgtaaaagtatgtgatcagtggcaggagatcaaaatataaataaaaacagcatgagcaccaataaagtctctagtaattctccgtcaaaatccctctatacatgttcatctccttcaactctgtcgtctccttctccaataccaaaccaatcaacgactggaaactcaatggaagaagtttggaatgatataaacctagcttctcttcatgaacatccaaatagccacacaggcagcaacaacaacaccgacgaccatgtttttcatggtatgatgtttcaagacctcttggctagatcttccaataaagacacaccaacaagggttgcctctaaggaaccctcatctggtgggggcaacaatttcttgaagaactctttagggccgccaccagctactatgctgaatttgaattatggaaaaaggcctcaagaaaacgatgacgtttctggcggcgatcggaggcatgagcgcatgatcaagaacagagaatctgcagctcggtcccgggctaggaagcaggcttacacgaccgagttggaacttaaagttgctctgttaggagaggagaatgccaagcttagaaagcagcaagaaaggttcttggcagcagctcctgctcagccaccaaaaaagcacaccctctatcgaacctcaacggctccattttgagaagtaagaaatttatgcttagcccatttactcctttcatccctttatgtttccacttggctatcttgccaaaaacttccttgaaaagagggagatgttttccatatatcatttcaaagggcttttgatgtaaaagaaaggaggggaaaagagaggtaggaaagtagcaaggacaaattaaagttgcctggac

SEQ ID NO: 10635 - DNA, 867 bp, Populus trichocarpa
  Predicted polypeptide sequence is orthologous to G598
ttttttttttttttttttatccttttaggacaagtatatctattaactaagcaccattttccgtcaataatatgaagcaatacaactgcacaagataaaaaggttgttccaccactattaccaacaggcccctcaaaattctaagcacacttacaaagttcaagcactcaaaaaagacacataataaccacccaaatcaatacttttgcagcttcgagtgctactcttcactgccccattttggatagggtgccctgctgttcaaaagatgcagggccctaacagtttggagcaattattgtggacactgttttttgtttgaaaatgtttcaaggagtactattatgtggtgctattaattatggctcaaaagaaggatcgtttggcaggagctctgccgacagctctcatcaaattggctacttcaagaactctagcaaccttggttcctctcttagcttcagctgatgcccttctctcctctgcctttctgtgtgcctttgctacctcattttgcatcttctctaaggctcttgctcttttctcctctaacttcctctcaaccttcttcatccaagaagtagacttttgcacctgctcactctcccacccattaattacagcatcttctctcttgagcctattattgatctttgcaatctttgcattttgccatgcagttatcttagtctcaacctcctcttttttcactctcatcaccgacacttcaccgccatggctaccactacccacacgaccggacccgagccttctcgagcttggttcggggtctgaagggttgttgtcgggcacaatagccaaagggttagtttcttcaggcacgtcatgatcatcctctccaattct

SEQ ID NO: 10636 - DNA, 862 bp, Populus trichocarpa
  Predicted polypeptide sequence is orthologous to G653
tttttggtagaatccaatatttgcaattgaaattcctccgcaagtaattttacatttgtgagaatttgaaacccatctatcaatcaaacacaacaaacatgcccagtatagctgggcagaaagagagaaaaaaaacaaggcagaaccaagttttgcctactccttccaatggaaatcggagggcatggaaggaaaacacaatgaaaagtagataaagccacacaaataaaatatcaaatggagatatttaagcctctggcacagaagccgctgcacgcttcattgttgcggacttgatgaggtggttgtagctgcccttttccttgaaaagttgggagaagtgatgcttgcaatacaatacgccctcaagtgctgcataatttgatggtgttatagcacagccaccgtgcgagcacttgaaacatgatttgtgataggcttggctttcaactgttaccttctcgagcggataagcagttttaccgcaagtagcgcacttttcttgtgtccctgaaaacatgctagcagctttgctaggtgaccttgtcagttcaggatttaacttctcagctgactttgcaggtgactgaaagttcttgttgaagttaccggtctccttgaacagctgctcaaagtgaggcttacagtacaatacaccctccatcgaagaataattgcttagctttaacgtgcctttgcagtgaaaacacttgaagcaagttttatggtaagcaaccccatctgctgatagaagttccataggatacacagtcttctcacaagccttgcatttctgttgggtaccagtaaacgacatcgtttctagctatataaactataccctctagatctgatgactgtc

SEQ ID NO: 10637 - DNA, 556 bp, Populus trichocarpa
  Predicted polypeptide sequence is orthologous to G653
gcttcgagcagtcttttgaattctatctggaatttttatcttgaatttgtacattttcctttgcgaacagctttaaaaatgcctttcgtcgcagccgaaaatccaaaatgcccaacatgcggcaaatcagtctatgcagctgaagaacgtgttgctggtggatacaaataccacaaaggatgcttcaaatgcggtatgtgcaacaaaatgttggactcaacaaactgcacagaacacgacaaagaattgttctgcaagaattgtcatggccgtaaattcggaccaaaaggatacggttttggtggcggtgccggagccttgaacatggatgatggtacccatcttaatcaccatttcgaacattttaaataagtggttaaatgacatgcacgacatctcccttgttctttgtccgttcaacagataaattacacacacgcacacacacacacaaacacacacaatcaagtaaaatccatccgcagaacgtgcataaaggaccttcaaaaacaaataccaaaatagaacaaaaatatataaaaaaaaaaaaaaaaaa

SEQ ID NO: 10638 - DNA, 890 bp, Populus trichocarpa
  Predicted polypeptide sequence is orthologous to G653
ttttttttttttttttttagcacctatagcatccaatatttgcaattgaaattcctccagtccttttacaattttgggagtttgaaacccatctatcaatcaaacacgacaaacatcctcgctgagagctgaagggagaagttcaaaaataaaaaaaggcagaaccaagttttgcctaccccttccaatggaaatcgaagggtttggaaggaaaacacactgaacagtagataaagccacacgagtagatatcaaattaaggaagagatgtttaagcctccggcacaggagcagctgctcgcttcattgatgcgcacttgatcagatggttgtagctgcccttttccttgaaaagttgggaaaagtgatgtttgcaatataatacaccctcaagcgctgcatagtttgatggtgttatagcacagccaccgtgagagcacttgaaacatgacttgtgataggcttggctctccactgttaccttctcaagcggataagcagttttaccgcaagtagcacacttctcttgtgtccctgaaaacataccagcagctttgctaggtgaccttgtcagttcaggagttaacttctcagctgactttgcaggcgactgaaagttcttgttgaagttaccggtctccttaaacagctggtcaaagtgaggcttacagtacaatacaccctccattgatgaataattgcttagctttaacgtgcctttgcagtgaaaacacttgaagcaagatttatggtaagcaaccccatctgttgatagaagttccatgggatacacagtcttctcacaagccttgcatttctgttgggtaccagtaaacgacatcgtttcgagcgatatgtattataccctttagatctgatgactgtgtact

SEQ ID NO: 10639 - DNA, 330 bp, Populus trichocarpa
  Predicted polypeptide sequence is orthologous to G663
ttttttttttttttttttgaacccttgaattgatcgaagcttacttttatttatgaaagttgtttaaatattattggaaggagccaacaagaaagtggctctaagaaattacacagttacaaagctcaaatccaagccaaaaggtcatgctttctgcgcgatatatgtacatatatataaactacattatgttttgttacacaggtggtcattgattgctggtagacttccaggaagaacagcaaatgatttaaagaattattggaacacaaacctgagtaagaaggtggtttctggcaccagagaagctcaaacaaaaccagaaccaac

SEQ ID NO: 10640 - DNA, 897 bp, Populus trichocarpa
  Predicted polypeptide sequence is orthologous to G666
tttttttttttttttttgttaagattagaatatatatttatatatattctaatttacactgtctgtgtaaatttattctcgacagaggaaatatgacatattagtaattaattcacatttacactgtccgtgttcttgctctaaagggatgggaacttctaactaatatgaccactgtgaaattgtatcacttcaaggcctagagcaaaataaaaagaaccagtgattctcgaacaaggaatccctttagaaaaaattactagcatattagtctaaatcagaagagcactcaaagtagccacaacaaagaagagccctcccactagaagagattatcttcatctattgtgacttcgtttatgtaatctttcccttgcatggctccttcatcaaatagccacctctcaatcaatgacagtggcacttgagcactggaatttggcttactttcgtcttggaaaaggccagtatcaggcgacatggattgagagaaatctgaatttgaagagtcgaaagagtcaaaaccaaagagtgattcaaatgcctgtgataatccagtgccatttttgtctgctttatcaggagtcccttcactagacagtgaatcagctccagccgtatcgatgaaggaattctgagtagttgaattttttagcgactgcttaggcccacttatcatccatcctttgagcaatctggatatattttcagtgcttgatgcatagattggttctgtagctggtttttcatacccacaagagggtttcaacccggttaacaagctgcttggtttaccgggagacaaggcctcgcatagggcttgcctagccatgttgatatcagtttgaagccttctctcccattggcctctagaaatttgctgtgaacctgttgatg

SEQ ID NO: 10641 - DNA, 378 bp, Populus trichocarpa
  Predicted polypeptide sequence is orthologous to G707
ttttttttttttttttttgactttaggagaattgagacaagggagagtcatgtcataagaaaaaagaagagttttgaacttgagacccctcgaaccctaaaaacggaaataactttagaatcgcttgttgttactgttttcaatttttgcagtccgtacggaaatactcgtctctatcttgacggtagaacacttctggattacaggaaatatcagtaagagactttcgagctttccttgggagaaaatgtatcaacgctatcgcatacatacatagacaatcacaataatcaagactttcgagcagagaagaaacaatatatcttgaagattattaatgtcagggagtggaatcggcaaagctaagctatttaaacc

SEQ ID NO: 10642 - DNA, 893 bp, Populus trichocarpa
  Predicted polypeptide sequence is orthologous to G707
gccgttgacactccggccatgcacgtagtgatgaacggtggtgattcggcttacgtggcgcttcttccgtcagggtttgctatcgtaccggatgggcctggttcacgtgaccccccatcgactaatggcggcccgactgctaataatgtcggtggccaagagagggtgagtgggtcccttttgacggtggccttccaaatattggtgaatagtctacctacggcgaagcttacagtagaatctgtggagacagtcaacaaccttatttcatgcactgtccaaaagatcaaggctgctctccaatgtgaaagctgattatgcaatgcatgattgagctgtccaattagtgagtatttgttagtttataaattttatcatggctgtgttggtctgttaattttatggcgtcagagagatagagagagcgctcgcttggtaaatgagtggggagactggaaaaacaaaagtgagttgtcttcttgttgatgtttgtgggtgttgagtcaagaacgaaccgcgcgtggtaactccttgcatggtggtgaggatttatgggccagtgactgctagccgggttgcagttggtatgcatattgcaaagagtgctcttaacacgaggcaagggtggtggttcgggcattgactcggtcgacctctgcctcaattactattactgaaaaaagagttaaaaccaacagtgttttaagaaagaaaaaatgggtctttctgatatttaaattaatatacagattatatatatataatctgtttttgttgaacttggaatgactagttcagcttgttgatgttttgtaactcgtggggttttgtattgttatgatattctaagtttactaataataacccccttttttggttgaaaaaaaaaaaaa

SEQ ID NO: 10643 - DNA, 725 bp, Populus trichocarpa
  Predicted polypeptide sequence is orthologous to G707
ttttttttttttttttttagtaaacttcgaatatcagatttaatacaaaatcccacaagttaacaaacatcaacaaactgaaccagtgtccttacaagttcaacaaaagcatctgacaaaaaaaaaaaaggcaataaaaaggaggatattaaattaataaatatcaaaagacccctttttttttcttgaacatttttgtttttgttttttgtactgctaataattcagccaggggtcgaacttgagtcaatacccgaaccagcacccttgccttgtgccaaggactttgtttgctgcatgcatgccactgcacccaagcagagccagtagtcacagtcacagacccataagtcctcaccgccttgcaaggagtctccacgcgcggttcgttcttgactcaacacccgcaaacatcaacatcaagactagtcacgttttttgtttttcccagtctttaccacactcatttaccaaggcgcgcgctctctctccctcccttttaacaccaaccacccttgacaccataaaataaacagatcaacacaccatgttaaaattaaaaactaatgaagactcactaataggatgaagctcaatcatgcaaaatattcggatgacgatcagctttcacactgcagagctgccttgatcttctggacagtgcatgaaatgaggttgttgactgtctccaccgattctaccgtgagcttggctgtaggaagacc

SEQ ID NO: 10644 - DNA, 928 bp, Populus trichocarpa
  Predicted polypeptide sequence is orthologous to G720
ttttttttttttttttttctatgtcaagttctcaactttattgaaaagtccatggagcacagagcaatatctctatcaccctcatttcccattattacagcaccacaaggaccccatcagctactcctggatcaaagctctcaggctttttatctacaaaaaaacagaacacccggaagggcaacgcgccctttcttaggatgatccattcacaaccacaaatttgacatgaggtgcatggtggatctacatggctctttcatagccgtttaagctgcctctacggacatgactgcttactgtgccattgacgggatcggtgagacctttctgactatgtggcctgatgtcagctcctgcgcatgcacttcaaagacacgtgacttgtctgttgaagattgatggtctcaagccacttgagaatttgctgtgtacgtgtcaaattatataggtcgaaaaatttgttatgattggtagagtctatcttcgattgatgaaggaccaggagaactggaatcggctttagcataatctgatgaaatggcaccacccacattagaaggaattagagccattaatgcggggaggaattgatgagacgccttgcctggagagctctgctaggacgctatcggcagacgggggcttgaggcccaagggcaaaggtagccatggcttgttgattgcctctttcactaccttgtcgataacctcctcggccggctgtaggtcaaacagtttttgtggcataccacagctgttattgaccatgctggcactctgaaacccagatgcataatgaggaatggtagaataaggattatgtggtggcatcacagggcaaccccacgcatctgcatgcatccctggataaggcttccaatgacaactttctgtcgggggccatggggagtagccgggggggccc

SEQ ID NO: 10645 - DNA, 863 bp, Populus trichocarpa
  Predicted polypeptide sequence is orthologous to G730
ttttttttttttttttttcttccttttcttttctttttctttagctctgattttctcacctgggtacctgattctcttcaccagcatcccctcagagataataatgattcaaaatgagtagtacacagtggataacttcaatgtggcctgcccaaagtgaactccaaattaggcttcttggggcttgtccctgaaacggtcgatgagcttacatctgatattttctcatagctcaagcactttggatccatgcccttctgctcaagtggtggtaagtttccgccagaatcctttaatttcccatgcaaccaagcttccctgcttgaagagttgctccagagagcctgatagtccttgtcctggtgagcatttggtcttccctgttgcattgacatttctgaccttctaggattttcaatgtcaaataccaaatcttctgaagtatctccagatgatccattatcgaacacgtccgatagcgccgaaggagctgctgctctatcagtggtcttcacagttcgatacatctgcaaatgtgatttaacatgtgccaaggtgagatctttcacatccataagctcaagaactgacttgggtgtagcccctaaaccccaacaaagaaaagagaagaacaaggaaagaggaaaggaaaatatgagtcaaattttcttttccaagttccttttttttgttttttcagtgttattgaagatggtaaaaaaaaatgaacaggaaaggtgaaagaagaagggaaaacttcggaaacgataaaaatgagaatctagaaaagaagaaagccagaggagaaaaaagaaacaaaatgaagcatactttcatggccacccaatagctcaacagcgtga

SEQ ID NO: 10646 - DNA, 772 bp, Populus trichocarpa
  Predicted polypeptide sequence is orthologous to G730
ttttttttttttttttttattattattattatttgtccttttattctccactaaagcatgcattctgtaactaacccatggcatcaaagggtagacaagagattaataagcatggtacagcagtggtaccttgaagagttgctccagagagcctgatagtccttgtcctggtgagcatttggtcttccctgttgcattgacatttctgaccttctaggattttcaatgtcaaataccaaatcttctgaagtatctccagatgatccattatcgaacacgtccgatagcgccgaaggagctgctgctctatcagtggtcttcacagttcgatacatctgcaaatgtgatttaacatgtgccaaggtgagatctttcacatccataagctcaagaactgacttgggtgtagccctttcatggccacccaatagctcaacagcgtgaacaaagcgagcatgaagagtggtagtccaacgcatccttggtgctctcatacttcttttagctggaaacctagacatgaatcttgatctcatcgacccttgagactgatagggacttatacttgtggcactagagctattagcagccagagaagaagcctgggagcaagtattatcaaaagtttgttgagagaatggaaaaagagaaggagggttttggtagacaggaatccctctaatgggtctcaagaaaccaagctcttggctcagtccttgttgttgttgctgttgaaagagcactggatgatgattatgcaggtggttttgtt

SEQ ID NO: 10647 - DNA, 662 bp, Populus trichocarpa
  Predicted polypeptide sequence is orthologous to G732
gatctctcaattctgcctggattatattatatagtaattagtaagaatatctatatacaatatttatcttaactctggatattattatcgctacctgggtcctgtgtctttgaaatctataaggttggaattctccgtactataaagatctcatttttatcgaggtttattgctggtggtagtgtttttggtgcaaaatatatagtctttctgtatctatatggcatcctctagtgggaattcctcaggttccactcagctgcaaaactcgggctctgaagagcaggtggtgttggtggatcaaaggaaaaggaagagaatgctgtcaaatagagaatctgcaaggagatccaggatgagaaaacagaagtacttgggtgatctaatggctcaagtggcacagctaaggacggacaataaccaaatccttacaaccatcaatgtcacaacacagcacttcttgaacgttgaggccgagaattctatcttaagggcacaaatgatggaactgaaccatagacttgattctctcaatgagatcctcaattatatcaacacaagcaatgggatttttgaaattgatcatcatgaggatctccaaactagtgcagatcatggcttcatgaatccattaaatttgatctatcttaaccaacccatca

SEQ ID NO: 10648 - DNA, 883 bp, Populus trichocarpa
  Predicted polypeptide sequence is orthologous to G732
ttttttttttttttttttagaaataataccattacatttactataatagcgaaatcctactacatcaaactgtaaaactcgcaagcccatttacagaccaagaaacaaactagccacaacccttttgttctttcttacatatccatctactccccaccccgtgacttctacatatgttgccttatttcaaactacttaaattataatcagctcttgagtgataatttcttaagcttgattattactaaacagatctctctatctctcttctgctcgagaacagatcagtaatgaaacatctctgcagacgccattataggctgattcaggtaggccatgttccatgggttcaagaagctgtcagctgctggttcatttaaggtgctcgagtctccaaaaacaccattgtttgaattcaaggaaccgattatctcattcaaagactccaatctattgctgagctcgcttatttgaactcttaggattgagttatcagcctcaacactcaagtaacgctgagttgtgatattgatgcctgtaataatctggtgattctccttcctcaattgagacacttgagccattagatcatccaaatgcttctgttttctcattctagacctcctcgccgattcgcgatttgatatcattctctttctcttcctctgatccatcaatgcctgcaaatcctcctccgaacctgagttttgaatcaaagatgatcccgaagatgttccactagaggaagccatgagagacccacaaaacaggtttgcaacttttaaacaagaacggcaacaaatagagagttatggcaagacccaaatagcaacaaactcaaaagtgaagcagataatagtagtagtaatagcaacaaactcaa

SEQ ID NO: 10649 - DNA, 758 bp, Populus trichocarpa
  Predicted polypeptide sequence is orthologous to G748
ttttttttttttttttttagtactaaatgagatttacaagtttattctacaaagagaaggattttgttacaaccaagaatctctcttctgtcaagttatctcacacacttacataaatatataaacatctaagataccatgtacatgaaaaacttaggaaacagatatcatctaagatggataaggaaaaactactggtcttaaagtggcagggaagtacatggtcctgtcagaggtggctatgctattcttgagagtcaaaatagggacacgctattctgggttcttttctctgtaggaattctgtcaataaggtggccttctggtgatgtaagtgtcaaccttctagtgtaaaagggaacacaaattcgttgagatttagaagctacagcactctgatgaaaaactccatttcattgcattactgttatagtagaaagtgtacaacttagctgatctctcatcaagtgttctcatggaaattgagagaccgggaaaacgcagcagggttcgcttgcaacactgaagttgttcctgccatgtaatttctgtcttcgctttttgactgaaagcccttgaagagacctcctccattaattgaactggatttctcattcgtgatcccgagggtcgcccatatagagctctttgcagcttcactaggatcatcaatcctcaaggtctttggaaccaaaacacccgtttctgatttggtgccgtccctggagggctcttctaagcagggtggattaaggatg

SEQ ID NO: 10650 - DNA, 599 bp, Populus trichocarpa
  Predicted polypeptide sequence is orthologous to G748
ttttttttttttttttttgaacaattgcaaaatagtacaactctagaagagatttactattccagctgacatggttgagatatagcaaacgagaacacaaattacagcatttgagaaaagatactggacttcagaaaactttggttagccttccaatggatgatggctttaatttatacatacaggccagagcttcatcttatttttctgcagattccaagcagtaagataggtatgagtgtattagttgaacctaaaataggccgcggaccataaccaccacgcattaaacaacctctgttatttacaatgacgacttgaagagatgtgttgacagcaccgccgattatgtagcaattgattctgaagaacttgcctttcagacttcaatcagaattagttgagcagaaatctcatgcgctgtgaaggaaaatcaatgtggtatactctccacaaaaaacatgtccccgtggttatgcctagagaagatcacggacgcaagtgaggttcacaatggaaaatctcagcaggtgtcctttagccactctcctggaatgtatgagagcgagaaagagctgctgggtttgcttccagtacat

SEQ ID NO: 10651 - DNA, 861 bp, Populus trichocarpa
  Predicted polypeptide sequence is orthologous to G783
gcttgtctttcagccaacgttgtttcaatcaaagatttggaagcctgtcttttacttttttctttctgggattttttcggctctgattttaagattttgttgactgagatgagcacgggctcagagcctgatgtaacagtggaggaggtgactggaaatcggagctttcctgctgggaagaataaggggaaagtcccgagaagaattcataaagctgagagggagaagctgaagcgtgagcaattgaatgagctctttcttgacttggcctctgctcttgagttgagtgagccaaatactggaaaggcttctatactgtgtgaaacgactcggctattaaaggacttgcttacacagattgagtccctcaaaaaggataatgtagctctcttatctgaatctcgctatgtaactgttgagaaaaatgagctgagggaggagaattctgtcctagaaaatcaaattgggaaactgcagggtgaactggaatcgagagtggctgcgcaatcaacacctgtcctaaacgtgccgcctccagaatttcagcaaccgccacattttccaggagactcgttcagattgcctgctgtggatgctgctgctgctgcattgcagcagacgccagctgtctttgtggttcctatccgtcctgatcatgtgcaaggtcttccaatggccacctcgaatgtgaggaaaccacatgctagatatccaaccgctgctgattcttggccgtctcaacttcttggagagcagcaaattgctaggaaggaagttcagtttagtggcaaggatagcgctatctgtaatcctggggaacgatgccatccttaaccttaaaaaacatgctaaagtgtagta

SEQ ID NO: 10652 - DNA, 856 bp, Populus trichocarpa
  Predicted polypeptide sequence is orthologous to G865
gcacccaagcccaacactaacagtcctttgatctgattcttgatgtgtagggcttattcagaagctgcaaatctagcaaagcaacagtcatttcatgccctagtgtcaccgtcctaaaaccaaaagatttagcatcaactgtcttttttcaaaggtggatcgcaggtatggaaagaggccacttccaccggaagcatcagaggagaaggaaaaggaacttgatgacttcccttcttattcttccacttggtcagagacagacatgtcttctatggtttcagctctcactcaagctatgggtactaccgacaataacgtcccaatggtgcaatcaaccccattcgctctccatcaatccgtcgtcaaaggcgaacctgaccagtctcaaccagtgcaagatcaagaaaatacaaggagaaggcattacagaggagtgagacaaagaccttggggtaagtgggcagccgaaatacgtgaccctaaaaaggcagctcgagtctggcttggtacttttgatactgctgaggatgcagctgttgcgtatgacaaggcagcgcttaagttcaaaggcagcaaggctaagcttaattttcctgaaagagttcacgagttcggctacttcatgagttctggggcttcaagcaatgtcatgactgaacaaaatcctaggccagttgctccccctccccctcccccctcatcatttgcaccagacacttacccagacttgcttcaatatgcacaaatcctttctagcaatgatgccaattttccgtactacacttcaaacctctttaatcaacaacctttcccccggccatttttcacaaagctttctatcacagcaacaactaaa

SEQ ID NO: 10653 - DNA, 871 bp, Populus trichocarpa
  Predicted polypeptide sequence is orthologous to G896
tccgctccctagccaatagagattagaacacatctccattaataaaccagaaatatccataaaaaacacctaacaacaaccataatgtatagttacatgcttgtaaattgttccaaatgccagactccgctccagctacccccgggtgccgaatccatccgctgtgttatctgtcaagctgtaactcacgtcgctgtccactctcgccatgctcctccaccatcaaaccccaccactcgtcctcctccttcgacgctcgcaccaccgtccccctacaaccacgcgccaccgggccctccaccaaaccaacacggaagaaaaaaggcagttattgttgggatttcgtacaagtactcgaggcacgagttaaaggggtgtatcaatgatgcaaagtgcatgcgtcatcttttgatgagcaagtttcagttccctcaagattctattctcatgttaactgaagaagaaactgacccctacagaattcccaacaaacaaaacatgaggatggcattattttggcttgtacaaggttgtcaacctggagattccttgctttttcactattctggacatggttcaaggcaaagaaattataatggtgatgaggttgatgggtatgatgaaactctatgtccacttgactttgaaactcaaggtatgattgttgatgatgaaatcaatgcaacaattgtcagacctcttcctcatggtgttaggcttcacgcaatgattgatgcttgccatagtggcactgtattggatctacccttcctttgcagaatggacaggaacgggcagtatgtatgggaggaccatcgtccgcgatcaggtatatggaaagggacaaatggtggagatgtcatttctttaa

SEQ ID NO: 10654 - DNA, 763 bp, Populus trichocarpa
  Predicted polypeptide sequence is orthologous to G904
ttttttttttttttttttgcccaaaaagtacgtagaggaatttatacttgcaaagaaaagaaaaaaaacatcttatcaccaatttgaaacctaatttatatcatagttaaagccttgagagaatgaatcaacaggccaaagttttgaaaaaaacagatagagcaaaccatattacctggacaagagcatttataatgacaagggggtcaaattttgagcagtaactcgcctcaatttaccatatacagcgggtgagaacatttcatagaaacaaggccaatcgccaagtctttatcttcagttaaagtgtaatgttcatccctgacaaccttaattaatgcacccataagcttctttgattgaacatctgctttcaaaactacaattcgatcttctttgagaagaatcaccacaatatttgcctccagtctctccacttgaccgatctttgagatgcttgctttgttaagaccacagcaatccgtagaaacactggctgactcatcagtgatggtgctgatctttgaagtaggaatactatcagagacagaggaagtttctgtaggagctgaaacaactggatttaaagctaaaatagagattgttgctgtttggcaacaatgattagcatcagaaatctctgagactggagatagatcataggattccttgttaattttcggggaaacgtattgagttgtcgacctaaactcaccgtcgaagcttttctttggattctacacaagtcacagggccagttagc

SEQ ID NO: 10655 - DNA, 925 bp, Populus trichocarpa
  Predicted polypeptide sequence is orthologous to G921
ttttttttttttttttttctttttaaataaactctacgatttatttattttttcactttaattataagtttcaaactcatatgatatatgtacgtacatcgatcactcacatatatataattaaatattcgaagtaatatataaaattctaattttttttaagtaatttcaccatttctccatccgagtctggttgaatctcccagagatagcagctgcaagcgcagctgtaaaatttggatctcttgtcaaagaagacgccatttgttggaccaaaattttttgaagtgcaggcacttccatttcttgaacagtctttgtagcagtatctccatgccttccactttggatcaaatcaagggtcacagtaggagctgaacttctgatcggtgattgtgtgggaatcggaccaaaattagaaccgtggctcgagcctagtgatggttcatgttgagagtggctagcgtggttgtgctctccttcataagttgctaccaaaatagaagggtcttcagcacttctttggaccttcttcttgacagggcaacttggggcaaatgagcacttgtagtaagccctaggagaaggattgtctctggtcaccttctggccatattttctccattgatatccatccttcacaaccaagcttgcatcggattcactagtcctaaagtaagtccttgaaatctttgatttcagattctcctttggccttttacttgactcttcatcaatagaactgctctctgcatttcctccacttattccattaatcacgatgctataatcttcactctcagcctttctcttccttgatgatattggtgtactgatttcttttacagaattcttgctcaccaaatcagctaaatgtttttgcaaagccatatagttatcgcatacaacacccaagcatttctgt

SEQ ID NO: 10656 - DNA, 938 bp, Populus trichocarpa
  Predicted polypeptide sequence is orthologous to G921
ttttttttttttttttttgaaaaacaggccattatccattaaatgggaaaaaacccaaatccaactattgaatctcaaaatgagttttggattcttcatgtaatcatatacaatcctcaaggtgctatcttccttgggaccttttgttcccccatgtatcaaatgatgtatttacaaatacattgccaaattcaaaatgatcttttttcggattacaccccttatctcaagttttggactctctggataataggtactgtaactggtattcctgtgtactaatggaaccctacataatttataaaactccaactaagttggtagagataattcttttcctatctaaagctgaaatttcaccacttctcgctgtgattttgctgaaacattcttcctgagattgctgaggccagtgctgcagtgaaattgggatctttcgtcagcgaagaggccatctgctccaccaagaatttccggacttcaggcgtatccgctcttggttttgagctcctgtcatcattccttgacttagattttgtgagatcaagagtaatggttggcccagatgaggctagggaggctatgcagggtgctggaccgagtgttagactacggtttgaacctgatgttgcctccattgaaggatgtggatggttgtgctctccttcataagttgccactagaacagattggtcatcgatactcctttgaaccttctttttgacagggcagcttggagcaaaagagcacttgaagtaagctcttggagaagggttatctcttgtgactttttggccatatttcctccattgatatccatctttcacaataaggcttgtatcaccagcttcagtcctgacataagccttcgaaatcttatctttaatgacttcttcccttggtttcttggatgattcttcatcagttgagctactctc

SEQ ID NO: 10657 - DNA, 860 bp, Populus trichocarpa
  Predicted polypeptide sequence is orthologous to G921
ttttttttttttttttttatatcaaaaactgataattatccattaaaatggcaataacccttgcttttcaaattgagtttggatccctcaaaggtgctatctttcttgggatgttttctccgtgtctcagatgatgtatttacaaatacattgtaaaattcaaaatggtctaacagaacctacataatctaattatagaacctacatagtttatagaactccaagttgtatgagcttcttctcctatctaagtagaaatttcaccacttagtgtgattttgctgcaacattcttcctgagattgctgcggccagtgctgctgtgaaattgggatctttcgtcaacgaagaggccatctgttccaccaagaattgccggacttcaggtgcatcagtttttggttttgaacttttggcatcattgctggacttagattttgtgaggtcgagagtaatattggttttcccagatgaggctagagaagcggagcagggtactgaaccgagtgttagaccatggcttgaacctgatgttgcctccattgaggggtgtggatggttgtgctctccttcataagttgccaccagaacagattggtcgtcaatgctcctttgaaccttcttcttgacagggcagcttggagcaaaagagcatttgaagtaagctcttggagaagggttatctcttgtgaccttttggccatatttcctccattgatatccatctttcacgataaggcttttatcacccgcttcagtcttgacataagccctggaagtcttagctttgatgacttcttcccttggtttcttggacaattcttcatcggttgagctactctcagagttcccattcattgc

SEQ ID NO: 10658 - DNA, 579 bp, Populus trichocarpa
  Predicted polypeptide sequence is orthologous to G927
ttttttttttttttttttgtagccctaaatgagatgaaatttataataatagaaatactgaacataacacaaatacttagttatttcttacaattaggaatccatggagtagatatcaagcttcaagagcatcaatcattcttaaacataattttgggtagagtctttgtttcattgatggaaacacacccgtttattatcttgtccatttgctaaaaattttacagtgcattaaggatttagcacctctaaccagcccatgacagcaaggttgtatggaatggaaaagatgccattaatgcactagagccaagaacgacttgccctaacaaccaaatggtgaagtccaacttcaagccataatcaggttgcaggttcctgcaaaggtggggtctggtctagttcaagaaacaagcaccaacccgatttttgttcccttgctattttaagttgcagcagttgtcagctgctgcaacccacttactgggcataacaatgccatgtcctctgtccatcatgcctgagaaactatggaaagttggcccaagacgattgatctgaaggaggtcaagttctccc

SEQ ID NO: 10659 - DNA, 830 bp, Populus trichocarpa
  Predicted polypeptide sequence is orthologous to G927
ttttttttttttttttttggatctctaaaagatcgatatgatattccaagattacacgaaccctttttacataaactgagaaaagaaagtgacaaacaataagccaagaatgatttgccaacgatatatagtcttcctcaccaagtgagtcagggtcgatgtttctagctttttctaaatggttataaacaatccctaatgatcgaagaaacaccttcaacaggatgcaagcaagaaagcatagagcggtaaagacatacgcccaacaaatccttactgcgtgtcaagagtgaataagcaaactcaatgaagaggcaccttgatttctcagagtttggtagaatccaccacacctttcagctaaacgggctttcatacaattaacaatgctggagagaccctcaactccttgtgctggaagtttcaattgagaggcctactcactcaccataatttgttatccctttctcccaccatcttttctgaaagtgaaggaaatttggaaaggtgatacctgggaaactgcggggtgcatcctttgctcagatatgtctgatgagggtgcatttgacacagagactctattacttccgcatcattactcattgacgaatcagagtttctggaaaagtgagacagcacaggtccagagcttgatgagctggtaaagtttcttgaaacagtttcatcagagctggtatgcttatcaggtgcagtattattggtagtgtcaggtttctttgtgttaagaaaacggcctccacaacctcttgcccttctcatagcatgtagatgccgggactcgtgaagataaggcattcgtttgcccc

SEQ ID NO: 10660 - DNA, 900 bp, Populus trichocarpa
  Predicted polypeptide sequence is orthologous to G937
gatcatcatccctctactgattacttgtttgatgcaaaacaaagcttcaaattagaatctaagacaaacaagaaagcaaatcagtatgtgaatgaggatgcattccaggcttgtaaaggcaggactgcagcaagaacatttatgccatttaaagcctaccctggttcgtcaaggaaagaggatgacagtaatagagaggaattgccggttcctgctctttctcttttaactcctggaattaagagcataaaagaggaatccaactctacaggttcaagaagcagttgtagtagatcagtttctactactgccccgaattcagaatcaaatttacgaaatggacctcaatcccagcagcagagttctaggaagcataggaggtgctggtcaccagagttgcaccgccagtttgtcaatgctttacagcaacttggaggcgctcaagttgctactcccaagcagattagagaacttatgcaagttgatggcttgaccaatgatgaagtgaagagtcatttgcaaaaataccgacttcatacacggagagtgccaccagctacagcctccgcccctgcaaaccaatctgctattgttttggggggtttgtggatggcccaagatcagtatggtgactcctcaaaggctaacagttccaagtctggctctccccaaggtcctctgcagctagctgtaaacacaggagggacctccactacaggaggtgatagcatggaggatgacgaagatgcaaaatctgagggctatagctggaaaagtcacattcacagatcaggaaaagatgtatagagtttgtccaccatgaattttgcagataaactatacatgataggattatataattatagaaataatactagaaaaatcacataatttaaaggg

SEQ ID NO: 10661 - DNA, 933 bp, Populus trichocarpa
  Predicted polypeptide sequence is orthologous to G938
gacatgttgagacaaacatgagtttcattcagaaaaggaagcagcctgctggtgagccacatatgatggttgatcaaaagatgtataggtgcgagtatcctcaatgcccctacaatgattccagatttgggtttctcgacgtcactgcaagaaataatcaccaaatgaattgctcataccgcactaacacttctcagggatttggaatgtctaatttccaaattaacagtgacaaaccagctgtgttttctctcccatttccccaaactaaggcagcagctccaaaccagaccccttcatttaacgtttcaggacttggacttccagaagatgggaaaaaaatcgatttctgatcttatgtctttctatgataccaatcttcagcgagacaagaacatgaatcctgggagtgccaatgttatcggagatcaaaatcagcagcaactgcaagagcagaaatttcaattccatctggaccgcaggaatgtcaattttatgggggaccaaaatctgcagcagcaacagcaacaacagaaatttcagtttcagctggattctaggaatgctaatgttattggtggtcaaaatcaacagcaacagcagaaattccaatttcagcttgatgatagcttctatggccaaggggctataatgggaaacaacataactgaagtgaccagcatgccagtgaacagttctgctttcccatcaactgaaatgcagtttgatcactgcaaggcatttgattctgcatttgatgccaatgtcaatgataatgttgctgacttcagatttggctctccgttcaccatgccaccagttgactattccatggatccaatgccaaagcaggatgctggcatgtggtacgtctaacactctgggaagaaagtcatcatcaacacagagcctgcttcatagttgtgaaacttc

SEQ ID NO: 10662 - DNA, 896 bp, Populus trichocarpa
  Predicted polypeptide sequence is orthologous to G938
ttttttttttttttttttgagtgttttgcacaaactttattagcacgaacggtacctgctagctatctaaattctacccctaaaaagagagtaaataataaaatacaaggacggccatatcagtttctaggcagtgagagtttgccctggatgtaatgcaagattagaaaagctcttccagtccaaggagatagttttggtaatgatattagaaccaggttgaaacatcctgatgctttggcagagtatccattcccagtacttgtagatcatctttgtagtcgaaagaggacaaatcaaagggggagccgaacatcaagttgaagccgctgttgttttggttggtctcgaacggagaattcaagggtttgaacctgtcaaactgaccaccttcctgggaaaacatttgatggttttggttgatgttggacccttcgaagatacttccgttaatcatattgctttgacttcggaagtggttgtcctgctggtgttggatttttggctggaaaacattgtgaccttctgtgaccaaattgttaccacgatttgtgttcttgttgccttgaatattagtgtcatagattgacataagctcactgatcatcttttgcccatcttcaggaactcctgatagattgaaggaagagggtgctgggttcaccaatggagcagttgtcttggactgtgcagatggttgaggatagatgacaggcttgacttcattaacatgaaaatttgaccctctaaactccaatgaagtgcttctgtatggacaatttagttgatgattgtccctagaagccctgtcggggaaacccaatcggatttgactatgagcacattgaacagcctcgcatgtgtagatcttctgatccaccatcatgtttatatca

SEQ ID NO: 10663 - DNA, 922 bp, Populus trichocarpa
  Predicted polypeptide sequence is orthologous to G938
ttttttttttttttttttatatctaacttatttgtttggcagtcatatcttatacctcatatgaaatcaagagcaggttaatttatgggaattttacacaaattttattatagcccatatgatacctgccaagctatctaggattctacaactaacaactgcgaaaataatacaatgaagtacacactagcttcttgccagtgagagtttacactggatttgtaacgcaagatcagaaaagctcttcaactccgaggagagagttctggtattgttattagaaccagattgaaacatcctgctgatgctttggcagagaatccattcccagtccttgtagatcctctttgtactcgaaagaggacaaatcgaggggggagctgaacatcaagttgaagctgctgttgttttggctggtctcaaatggagaattcaaaggcttaaacctgtcaaactgaccgccttcctgcgaaaacaattgatggttagagttgatgttggactctttgaagacatttccatcgatcacattgccttgacttcggaagtgattgccctgttggtgttggatttttggctggaagacattgtgattgtcctgttgatgttggattttcggctggaaaacatggtgacctcctgtaaccagattgttaacaggatttgtgttcttgttgccttggatattagtgtcgtagattgacatgagctcgctgatcatcttttgaccatcttctggaactcctgataaatcaaaggaagggggggcagggttcaccaagggagcagctggcttggattgtacagatggctgaggaaagatgacaggcttgacttcattaatgtgaaaatttgatcgtccaaattctaaataagtgcttctgaaggggcagttcagttgatgatttgtccctagaaccct

SEQ ID NO: 10664 - DNA, 506 bp, Populus trichocarpa
  Predicted polypeptide sequence is orthologous to G962
ggttttggatgagatgtggatactaaccctatcacttagggtagtatattcaagaaggggtttagaatccattgaaggaattgcttcatcattacagatttcctatgccagatataagacattttgctccagtagaatagcaatgagatcaatgtgtcagatgatggcaagttcgaatataaaatctttgagaattgattgcttcacctgactttgtgatctcgccgtttttctattgatggcagggtgtttctttgcatctatgagaaaatgttaatttccctattttgccagctttactctggcaattagacttgtttcagcttatgttctgttttctagcatcttaaaacatattgtaaattagtctcctctcctctctctaggacctctaagcttaccctgtcatgtattccatttctgaactctattgtagcatatttggatggctttcttatgaatgtgaattctaaataaatctttttatgaaaaaaaaaaaaaaaaaa

SEQ ID NO: 10665 - DNA, 936 bp, Populus trichocarpa
  Predicted polypeptide sequence is orthologous to G975
ttttttttttttttttccttgcaaatcaggcaaactggttttataaacactccacaagttatatatatctaggcttgtggcccctaatcaacacaacttgcattgagaaattgtgtagggttcaaagcaagtgattattggtttgtacaatatttccacagtcaccaatcacaagaacaaataagttccttaaaccatggagattatgaggtgggattctgtgattggcaactatacatggaggaattggacaacttatataggaagggaatggagaagggattcttatactagctagctgccatgtaggacatgcatggaacaagggtcaaggaaggtttaatgtctaaaccccacaagaaatagaggtaaattaatgtcatcaattccgattgagcagctcttctatcatttgcatagcaattctatcctcttcttccgtaccattttccggctcaatctcaaccgtcggcgatgactctgtcttcttgttgtaatttccaagctccaccttcatgacccaatttgaacttgaacgagaaccagctttcttctgccacacaccaatatgagagttatcattatcaagcctcaggcaagtgagtgaaggagaagggtctttgccgcaacactttcttagctttgagttgagaagctcagccagtgccttggcaggcaagggagagttgttatctttgccaagatttgtgtcttgatcaaggtgacttgtcgggaaattggtcttggcattctgtccattcatcaatatagctgcttgatcatacgctcttgctgctgcctcagctgtctcaaatgtccccagccacaccctcctcttcagtaatgggtggcgaatttcagacacccaagagccccactggcgttgcctgacgcctctgaatttctttgattgtaccatgtttcgggagaggcaat

SEQ ID NO: 10666 - DNA, 778 bp, Populus trichocarpa
  Predicted polypeptide sequence is orthologous to G976
ttttttttttttttttttgcagatggaaagagagacgtactctggctctagctgacacatttaaatatatacaactaacaaatgtggcagcaaaatcgattcaccaaccagtttttacctttatctacacaacactccattgcctattaccccatagaaaaatctttaataaaagccaaccttttgttacatcatgggaccaaaacctctccctttgaccaaaaccaagaagcaaattctccatggagaagctgtttgggtttgctttagtggtaggaccataggctttcagcatcggaactccctggtgaatcatcagaagatagtgtgtttattcttggtgggcttactagcattcctcctgccatgtcaactagcaaattgggcatgtttaaaagttcttcctcgtcgaaaatttcctgtcctgattgaacatcagcagtgataatagatgatgagccttctgtttcaggctggcccatctcagggtttggcccactttcacgcttgggtgacctggctgatgctgcactagcagctgcagcccttatatcactaggggatgctgaggctggtgttggataggaaaggattgattccgggaaattcagtggcgtgttggtgcctttaagcgctagagcagccacatcataggcggtggctgccatctcaggagttggatacgtaccgagccatacacgcgtagttttacgtggttcccggatctcggatacccattttccactccgtaacctaacacctttaaaagtcgggtgtc

SEQ ID NO: 10667 - DNA, 761 bp, Populus trichocarpa
  Predicted polypeptide sequence is orthologous to G979
ttttttttttttttttttggtcctttgaacgtagccatttgacgtagcggcttaggtcaaagcttgtcacagcattaagtccacggtactctatagctgccatgtcatatgctgttgctgcttcttcttgagtggcatatgttccaaggtagaggtacttgttgccgaaaactctgccaattcgagcttcccatcttccattatgatggtgtctggctacacctctatatttggacacaccgcgtgaaaacccactactttttctcctcagtgatccaatatattcttctttcgaatgaccctccatctctttgaattcttcttcgtaagttgacagaggaaaattgaggatagtatcctgtccccagtactttaatgctgccaagtcataggcatgcccagccgcttcttcgtcatcgtaggcccctaaatacacttgtcttcctttcttgttctgtgactcattccagcagttcttatcccacaaatgagcctcataacgtccggtccatcgatgccttgtaacgcctctatagatggagctgcgttgaggaggagagtctcgaggaacactctttctagtccgcttcaccttggttgcgggattaatgctagtgtttgcagagttctttaggctttgcttcgatgtttttcccatctaacttcaccaaaagaaatgcacaaacacacacacacgtaaaaaaagtgttgggaggcagattttgagagagggagagggagagagagagagaggaggggga
